United States Patent 10,407,724 (METHODS AND COMPOSITIONS FOR SCREENING AND TREATING DEVELOPMENTAL DISORDERS) - sequence listing, part 49

SEQ ID NO: 1108 - DNA, 1101578 bp, Homo sapiens
  misc_feature (686218)..(786217): n is a, c, g, or t
cgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 1109 - DNA, 936220 bp, Homo sapiens
  misc_feature (520860)..(620859): n is a, c, g, or t
tgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 1110 - DNA, 59284 bp, Homo sapiens
ctaagttcaaaagtacatttatttaaaatgtgggcaagatatcaatataaaagaaaacagagtataagaaataaaaataatcaaagtacaaaacatttcaaatctttaacatccataatttagagatagcaaggtctttatttacaccattttatttctagttgaagtcccgtaacagttttgtgaaaacatttaaaaacctggcaaatgaatcataaaacctaatgtgggctcttaaagtcatataatacaaaacataatttatgtttcctcagaataaaattgcacatcttaaaaagatgcagtatatttattatatctgtcttcctgcttcacagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtagtgacctctgcaattctaaaccgtccactttgggcaaaattcatcaagctatggatatgaaaaaaggcccccaaggtaatactcataagtctcctgtatgacttttaaagcaatttcttctgaaagtaaatgtagtgtagaacaggctttcacaaatacaaacatgaatgttaggaaaaagtctggaaaaaatgcaagagtacatgttgtataaaaaccaaatgcttatagcatatctgtaaaaatttaacaggcctcttatcattcctatcagtagctcctacaataattttctaatagatggcggtatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagctctttagcgttaagaggaaaatgtttgataaatgtaattaactggatgaatgtcagtgtatttaaatgtaaatatacttaaatgtaattacctggatgaaacaggcacacacgaagaaaaaaaaactcggcaaggatgggtatcattctgacctctgcgccttactgaagcagtcctatcccaaacacaaaattcccctgcttaaggaaaggtccactgaggttgacactggtcagaggtggcagaggctcccaccctcacagagaggaggagctccagcctcattgcaggaggcccagggagaagtcctgagaacagccctgagagaaggtgctctgcaatgggaaacggaagtggaaacagaattttcccataaggacctgtaaggcatgttttgcttcactgataggctgttcctacattaaaataataattcagagatttttaataaggaattcaaataacagatgatgagctttattttttcctgaatgtctgaaatagaaaaaagcctaggtgtcaatattctaaagactgacctttgcattttcctgacatgttgatgaagtattcattctgccgcttccatttagtagtaatttatctcccatcccaaagttcctgagtacaaagactatatacgaactaaatttcatttggaaaactacaaactcaaaggtgagctgataaaaagaaacatatatttatttttgcaattattttctattttatctaattgtcaaattctttaatacctccataaactagacagtatagatcctttctaattaacatcacctattaaaactgaactctcagtaagttaagagaatatttttactagcaactcaaatgaatattctgaagagaaaagaattgttcactgcataaatcacaatagcaaagaaaggaaaaatggcttgcaaaacaggaaaggtactgccttattaacctgggaaatccatttcatatctaacccgtctactttttaattctcttttggaaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggtgtgatgtaaaaatattttgcctaaaattaaatgaaaatatatgtattatgttcttaaaatgctttaatttttagagtacataattctcatagattctgccctgagatttttgacaaaatttcaaattttatgacattatgaaggtactattctcctactagcactcaatctgaagtggaagaggaatccagctatgtaaatttggaatgtaagcattttcacatgttaagtatgcctgaagatgatttaaagtaaccagaacttaagtccctaaaacaaagtgttttgtgaataagcaagaatattacaaatatttttcacaatttctatacaattttaaatcagcattatatttcaccacacttatctgcccagcaacagcctctggcatagcatgctgcctggcttatatcccttttctttattttctccatattatttgaactcagagcaggaaatgatattgatgcttaagatttaattatctaacaagattgctcctgaggataccacaaaatactattctgtctgaaactgcaaataatttctaattcctgttgactccttaagaaggttaaagaaccgattatctttattgatttacttagttctttggtacaaaaaaaattcctagctgttctaacacttatctaacatttaaaaatcttttagtactgaattatatctatgcacacactgaatattttcccaagtatcttctccagctgaatatacatttactgacaatagtacgaagtaagcgatgtcctctaaagatttattaaaagcagaaaaatgaacatgcctcttaaccaattactcaaaaacctattctttgaataacttatttctcatagatgtatttattaaatttgtgtacttatttttaaacattatagtaaagaaaagttctctagagatgtgctgtggttcacaggaggaagacctccagtggcaatgtccaagaaggaagccaagaggtaaatgggatgcagggtgagcccagctcccctggaggcgcacttcccaccaaatcacctggtagttcccttgagcaggtccgtgtgttatgcttacttggactgatttacttttcccttaaagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcaggtacataatattacagctacatttacctgtacagccttcggatatttaaatgtcaccattatatttcatttacttccctctaaaaacagccagaccaaaaagacagacaggtattttttctcctagatcagtggtaattaaccatttggggtcataaactcttgaaaaaaacgggctgggtgtggtggttcatgcctgtaattccagcactttgggaagccggggaaggaaagctgcttgatgccaggagttcgagaacagcctgggcaacacagtgagacttcatctctacagaaaaattttaaaatcagcttggcatggtggcatgtgcctgtagtcccagctactcgggggactgaagtgggaggatcgcttgagtctgggaagttcgaggctgtggtgagccatcattgcaccacagcaccccagcctgggcaacaaagtgagatctggtctcaaaataatagtaatttttttttttttaacaacaaaaatgtaaaaaaagaaaaaaaaaattactgaaaaatatgaaccctcttcccatagctgctcctcccctctttaccccccgactattttaggaagttcaccaactttccaagcccgcagatctcaggttaaaatctccagtcctagaaagacaagcttcaaataatcccatccaagtgtatattatatatatatatgttatatatatacactaactcctcaaggacttgtaggacattggagtcatttggctcataatcaattatgtgaattaccaaactttaaagatttaccaaacacacattcaagtatataaaagtatacagcaatttataaaggatagttttatcaatttttaaagacttctgacaattattaataattgacagattttcagttttcatagcaacattttaagaaatgtgtcaaaaggtaaagatcacaaaatgtttcaatcttcctataaatatgcctcatattcagaaaaccatttctcctccgccgccatttcctaccaaccatacagcataataaggcagctcaaacccaataatatatacatcaaaagcagaaaacaaggaaaagtgatttgggattggcaaactggggttgacaagatgatacatattttaggatttgtgggctatgtattatttctcctgcatattcctcttctcttttttaagcaatatttaaaaaatgtaaaaaccattttcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaaaaaagtactgttacacatgagatggtatatttgaagtgttactttcaaagctgatatgccttctgaagaacttgtgtgagatcaccaagaatagttaatgtttatgatagagaaaacaccaccgggcgcggtggctcacgcctataatcccagcactttgggaggccgaggtgggcggatctcttgaggtcaggagttcaagaccagcctggccaacatggtgaaaccctgtctctactaaaaaatacaaaaaaatttagccaggcgtcgtcgtggtgggcgcctgcagtcccagctactagggaggctgaggcaggagaatggcttgaacccaggaggcagaggttgtagtaagccaatggcaccactctactccagcctgagcaacagactgggtgagactctgtcttaaaaagaaaagaaagtaatattgaaaaatacagtaatacagctaagacgatcctgtcacagatgagacattgagattttggttttttcaaacagggttatgttaccttagtagtagcaatgtaaagactcaacctgaacattaaacttttcatggaagtacaaaagaaatgagtatcctagaaattgattataatattgatgtctcaaattttatgtaagttacacataaatataaaatcccaaaaacatgcacctaccaaaacaggtggagaaaagagtgttttcaacaaatgatgctggaacaactgcacatccatatgcaataaaaggaagctggacacagactttaccctcttttaaaaaaaactgacccaaaaatggaacacagacctaaatgtaaaatgcaaaactatgaaactcctagaagataacacaggagagaatctaagggaccttgagtttggcaatgactttttagatacaacaccaaagacacaatccatgaaagaaataagaagtaacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatgatcaagcaattgcaaccttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagcaaaggaagcaaatctgaaaatcctatatactgtatgattcccaatatgtaacattctggaaagggcaagactatagaaagaataaaagatcagtggttgccaggggtcagcaggcaggaaggaatgagtgggtggagcacagaggattttcagggcagtggaacaactccatatgacgctgtaaagcaaaatcatgtccttacacatttgttaaaacccaatgactgttcaaggccaagagtgagccctaatgtaactatggactttgggtgactggccaagagtgagccctaatgtaactatggactctgggtgactagccaagagtgagccctaatgtaactatggacttcaggtgactggccaacagggagccctaatgtaactatggacttcgggtgactggccaagagtaagccctaatgtaactatggactttgggtgactatgacccaaatgtcaatgtagcttcattaacagttaataaacatttcactgtggtgtgggatggtgactgtagtgggggtggcggtgtgtgtgcatgggtatgggctggggtatatgggaactcactgtactttctgtaattttgctgtgaacttaaaactgccctaaaaattgtctatttttaaaaaacaataattataaactggaaaaattctcttaggaaatcctaaaatatggaagataaaatatgaaatgttttctcagtattaaatgtttataacaaccactttctaaccctcagagagcaacacagcaaatacttattaacagtgccataaagaaataaaagctagtcaaccaaaacttcccattaaataggaactgtaaactttatatacagataaaacaaccacattttcacaaactgaaacttgaaaaattaagtaaattggtcattcactaaattggctgcttggcaaactaattttcaaagaattagcatgttcttggttggaaaagaaaaagaataagcaaagtcagaaagtaacaaaaaagatctctaaagctgggtgttgcccaaaagcagccgatggagccaaccagaggctggaacattacagacccgctttccccaccacccaagctggtgtatgccatgctcccacagcagaagctaaaaaagtacacttactatttctattaacgaatagactatctccttctaaactgtataacattatatgaaattggaagctaaaatgtttgtagtaattgtttctactatgttcttcttctgccttcattgttaagttttatgtttcattaatacctttttagagtcaaaaaattttcaaaatttcaattaaaaaaatttctaaataccacttagtacatgcgagccgcattatttcacagattctttgctaattttcctcccctctgaaatttatttatgaacccacaatcagtgtctgtggcacttcggtggccatttgtggacgtacgtggactggaaaagattcagtcacccacatgaacgttcctagccgggaggaacaaggccatgccttgccttcctgttccagctgaaatggtgaataagcatcctttttgtgatctatttagtgctattgctttcaaatttgtgtgctttatgttggtgattttgctgtttaaaatgtccacagccctaagtgcaagaaggcagtgatgtgccttatggagaaaatatgtgtctcagggaagcttcatgcaggcgtgagttacagtgctgtggatcatgagttcaatgtcagtgaattaacaatatacattgaataaggtacctttaaacagaaacacacataaaacaaggttatatatgattggctgatgaaaatgtagtgaacagaggcgctcaggaacctaaccccgtgtttacccagagactacagtacagcattcactaactcagtgtctgtgcaactttatagagcataactacctgtatgacaagaattgcctgaatatcatagttgaggatttagtctttccttcagattaatgatttattctttcctgagtcttactgccttagatatacagaatcataaaattttaactttacttctagctttgctataaacagcaatcttaagtatctttatttttctgggtcttctcatctgtaaaattagactacatgaactttaagatatatacacttctaatttatttacataaacatgaattatatttaaaatctgtggccaaaaatgtgacatgaatctaaaatattttaaatttaaaagatggatttaatgacgacttgtgtctgttaagtgataaataaggtgagtttagccacaagagtgtaacgggacctagtagcgccccctgcaggccttgcttgctccacagccacatgacttgctcttccctttggcagctgtatctttctgcttaaggggtcgggggcgagggaggcataggtgagaaagtgcgagaacacgtcaatatagggcaaacaactggcacagaaaaatgagcatgtggatgctctaaatcaggggctggtgatcaatatcattgctacatgatggagtagccagggagctcagttttagtgccagtgtggttggggcagaaagaccaaatgagaaaaacgactgagaattcagtgaagcttgtcatggggcatgtgtctgagcctttcaacccagacagggcccaggggaggatggaggacacagctggggaagctgagaggtgcctgacctagatgacgcactggggacaccaaccctgcagacacagggtgacaccactcctatgcaggacagtaagggcacatagctgccctggctatacaacctccatgaagaaaaaaaattgcttagaatttatacttattttatacctagcaaggttctaaaaacatttaggtgtgtatcaatctaagaaaaaactatcctttacataccatgtctaaatgtgcctgttagtaaaagaatttctctttgggggctctgaacaatggaagatgggcaagaggacatagatgtctttccctccttatataaactgatattcaaagtgtatttgagtaggacatttacatacacctgctctctttccaaataaagaaaaaaatacttccctgcactttgaaaaatctcattttacagccagatttccaaacaaaatatactaacaagaaaataaaaagagggatatagaggttgttttccccctaatattgtccaatttaccaaaacttttacacctagggtaaaatgcaaagacatcaatcaaaggaatcactggggatatgaaataaatttttaaatttaaatgaataactatcacatagtttaaaaattaaatatttgttgggatgaaaagagatgaattcaagaaaaaaaaaagtttatttggcattaaaagcaaagttactggcgctgctccttaccaatgaacttctgacacctgaagcattcttccagccactctggcgtcactatgtgcttcacgacagaaatcgccgtcaggaacttcacggtgcgagtcactttgctggcaatgaggtgtgtgcacttctgtgcagactccgcaacctctccaccaagaatgtagagcttctaaaggtcacaaacacaggtcggaaatgaaaaagttcagcatccacagagccacactgacacagagtaacacagaggaatatctacctaaagacaaggtttatgactgtaattctcagccacagaaaacagtgtgacaggtaaaacaaaacctgtaactacaagagaaaaataaaaaagagaatttatcatttacatttctgtagttcaattccacacaaatcaagattaaaacatgaattctccatcaaacatcaataacatatctccatgaataaattaaatgacatgagaatgatgcagctcacttcacaatgaagagtaaacagccaagacttcctaggccaaaactggtgttaatgaagaacatttacctgctatcttcattttttgaaatgatagcataaaaactggctaagacttgagcatataaaaaagcgagctcctaataactatcctcacattttaaaggtggagaaattaatttgttctaaatgtataatactagcatttataattgtttcttttccttaaaaaggaaaccaggagtaaaatgtacgaatccaccataatacaggtcaacttatactcttaaccatcctctccctcaccaaaacaaaacaaaatcccatcatcctttgggatgttatttcaaaaagtatatttaaaacctgtgcccatttatcatctaaacaaatacacaaactcctttttggcctcactctacccaagaaaactaatcttggatagactgtgtttcaatcagagatcttgaaaagacagttttccttcatgctggatgtctttatgaatacgacacagaaggagacttgcaaatgttcatgtgactattaacatggttcctggcctatactaataagaaagcaagtatctaagtatgaaataatagcacagaacagggcaggaagccactaaatatttagttattactataaatactactaaaaatacttcataaatatgcaccataaagactgttataactatctaaactatgtaagttaataaaactgctgatctgaagtaaatatatacaaaaaaggacactgctaaaaatccttgtacgaagtagatgaaatttcaccttaatatactgttgaacctggacaggctcgaatccagtgaaaagcacaaaaggggtcaattctggagttagctttttagtgggaggtggtacgtcttcaattctgtggaagaaatacacataaaatagtagtgatttcatatttacttacaatgaaaattttctttagaaaacaagggatttcattagtttaacaagctttaactgcatgtggtttttattcttaaaggaaaaatacaatgagctatctgtccttcctttctttccaccatttccataaagtcaccttccaaaaaagactacctttgaagcctccaagggaggcatccaattcacttttggttaagatcaatactttcttcttcatcaatcccctcctgattaatttttttaattggctttcagaagaaagcaaatatcaaagttgcttctaaacatcactgattttgctagctctatcacttcatttttttctatcaagtttttaagataaccttgtgtgactcaggccattccttgtttgcacgttcaccatcaatacaagtcagccaagacgagtgtcgctagagcttccagtgtctttcacattctagccctcttcaaccacaaattataaaaacgtggctctgctcaagcacacgttttaaattaaacctttttgttttttacatgaattttttaggtctttttttcaggttattattttctgagacagtccaataaaaatttattttaaaatgtatttgtggtaatttgatgacagcctcaaaaaaatcacataattaggattttattacaaaagtcaacagttcagtttgtgttctggaagtggggaatggaaggagggaaagaggaggagcagggagagaaaagatgaggaacctggtaactgcaaaaaacaattcaagcagttatatttcaccatgtacagtctggaaagaagagttttctagaatcaaggaagaaaataaaagctctgttagtttgctcctgcatttgctatgcctttctaattaaatgattggaaggacttcattattgactcctgctggccgacatgacactaaaatgatatgcatctcaatctgcatactccaagccaaaacccaacatgccatatgcattgcacatgtccttccaaaggctttgggtctggatcctccttcccaccgtggccaacattgctttgtcctcatcaagaactggcagatccaaggagcatacccaagatgacgccacagcctacatgctctctcggcacctacatgctctctcggcacctacatgctctctcggcagcctacatgctctctcggcagcctacacgctctcttggcatgtacagcaggttcttcagccgtgcccaggaggcctggggctccgtggtctatctctgagctgggttctagacctcccaccccacttccaccactgcaacttctgttttacatgttggaaaggggcttcttataatatgccacttaaagaaaaagactgaatttttttaaaataaaaaatatactggcctatgtcattaaaatgaaatatatcccaataaagttgtaaagcaaaaagcaaactctttcaaatcttatttactgcaaaacattttagaaactttcctcaattgccaccgattttccaaagcagacctgtgaaagccagcaatgaaaaatttaaggttattactcatacctggctcttttggaagaaggctggacattagctacttcattctgtttcagtttgggaggtagtcttatactctgcaattaaaatattgtcgactttaattcaatcaatctactaagtaatacagtagcttccagaagatttatgtgtcaaataatcaaactacttaaacatatacaagaatcatgttcttcttcaccacatcagaactagtcttcacctcaaaagatcactaggacaatgcaagtggggagaagcagctaatattccggagagaacctctgtatcgtttttttgttcttttctttccctctttattcacaaaatcctttcagtactttaaattatctttgttgctttttttcctccatgttatatatatgcagccctcaaccttgaacttctcaaaatggtttttatttcaaatattttgtcctgtgtcccaatttagaatgtggaaaacatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaagaatgtggaaaacatgattgaaattacacctccaccctaaaagactattcctaaaagagaaatttcacctatgagatttcacaaaagatgttacatgacaatcagatcaacactgctaccaacagccagacaaggtaccaaaacctacactctgcctcagcaacatggtcacatccactaggaccagctccagtccctgaccctggagcagaagccatgccaagcacaaagagagcaggaaggagatgggattcccttgtggggtccctaccacagtcagcatctccattctaccctattccttgttgactcctccttcatagtttcaactcagaggttctttgacttgtgtgggccaaccatgtctttcccaggtgttttattacttgaaggaattgctctcaatcttattaatttacttcaactacaacttattttttctaaatattgctgccatatctagacaaccaaaataaatatatctacagaaagcattcaaaatctattagccctgtcatacatagagaatcaagctttataataatttgcaggaaagtttattactttcctattatagcctttataagaaagcaatttctcaactctatttccaaagatcgcatttaagtctccaaattgtcattcattggtaccaagaatagaaacaaatggtgggataggcaaaaaggataaactgggcctctttgtctctaagatttttagcttttaattactgatacaaagccacaagagaagctgacatttggggcccctgacaactttagaatataggccatgtagtttgggaggaaaactctgatgaccactttcccagtgtgagcttaaaagccaccataaaattcctttcagctaaaagaactgtgagaatatttgcttttgctgatgtgtcaaaactggtcatgtctttaaaattaaaatcataactactagtttaagctaggaaaacaatacatctatgatcacattatcactagcaagaagaaaacaagactgtggcttggaggggcttcctcagagacgtgggatgattatcagcagcttccagatgagatctggaaaacgagtaagtcagtagatgaataaccagaaacacaagcttgggtgttagctgctaatcctcatgaaactattctcctcagctagttgttcaagtggcacaatccctaaattacctctgtatacaatagaaatgtggtgaaaacttggtgggcacatgacatggaaatctgtttttcaaaacaaaggttagtatgtaacaacaagaacataaaccaaagcctttaaattacactactactggccaacagtaaaaaaaactgctgttctcaaagtgctgatgttcagtcgaacagtgagaagtcacagcagacaaagtctaaactgaaaaattattgaagtggtcctgtctgtaacttagtaaacgtgaatgtggggaaaagagaaaaaacaactgatcttccactcatcatgcttgacagatgagaatgcagaaagcacctctttgtcttgtaactaacaaccaatggccctcacacttcaagaatggcctatcctgaaaagcagagacctccagccctgtgatgtgactcccaactcaggacactatgaaaacattcccctcatcaagagacccgggactccttaagttctgatctgtagccccaagtaggttacacacccattgcttccagtggttcttaaagttcttgcctttctaaccctatgaaaaatcagtcctaggatttactggagtagataattcgttatcatgttgacaagttactaaaataatttttaatttatgaagacaaatacatccctactgcatcttaataatacagtaatagccaaggtaaggttattaatttgacataccatcaacaactctgcagacacttttaagggaactctccaagcatctaaagagagaaacacattattttttatgatagatacgttgtttaaataaaaaggcctttttataaaagtcttccctgataatcctcaccagacaggtggtttagctgacaacacttaataaggataaatgtaagtactataatgaagttttaaagaaagctttccaggcaaggtgagggcatgctgctgctttcgtttcacatgctgtctggatgaagtagcactaagaccatcggcagcaaacaacaaagcaaacgttgtgtcgaaacccatggcattcaccctcccaccgtgggttgtctgggtacacatttctaggcctgtgtccaagtctgggtttcacatagtctggcttctagcaggcacaaaccttcttgccttatcacaggagccatgatggcatccaagatgtaacagcaagtcagtcaaagctcaatagtgacaaagaggacagacgtcaattctaggaaagcagggaatgttctgtagggtagggagcaatttggacaaaagattaactggcctgagaggcaagactatcaaaaagctttcaagcgctccttccatctctaagagttcatcaaaagcaaacaaaaatactaaaccatggcacatgcctgtagtcccagctacttgggagggtgaggtagggaaatcacccgagcccaggagatcgagctgcagtgagtcatgatcacaccactgcattccaacctgggtgacaaagcgagaccctgtctcaaaacaaaaacaaaaacaaaaacaaaaaccaaccaacaaaaatcctgggcagagtggggagaaagaagaaagagtatagaaaagaaattggaaatgagtcaaaaactaattagaaagctcaagccaggcctggtaattagtatgaataaaaagatggtagaagtaatgctaatgattttatttaagtaagatttgcagcatgtagaatttcacttacctaaaagatttaaaactaaatgctgggtaggggcaaatggatcctgcagactgaatgccgtgtagcgactatactgaatctgcctcagtgcctcaaagtttcccagaagaatgtcgccaagccactgggcgttgacacagggtatcctccactctttggctttttcatactttaaaccagttggtctttttattttttgaggagaaaacatatttattaaatgttagagatgtcaactgtccaaatgtacatttatttccaacaaaaggcaataaaaaatttctcataatagaagtgggaggcatatcctagcaaagttgagggtgaccctgaatggtaatgaaatatacacctcaaggctcacacagaattacaaaaccactaaggagtcttacttctaccctattcctgttttgttcattcaaatttcattagttcatctaatttcattaattcaaatgttttctaggtatttctactaacattactatatcattgtcatactttaacagactttgatttccacaaatttctaccacaaaactatgacatactaaaaaaggcacaattattgaaatagccactatattgtgtgtaaatttatgattaaaaacagtttcgaaaatttgcttactctttacagatgaggactgtgttgctgcggcatagataacccgtatatttggcacctgccaaataagccattaattttaggtcatctctgtcactatcaacaaatccagtcacagaaataatctaagaaaaaaagagaaaataaggtaaacacaaaataagcaaaaaaccaaaaccaagtactatttcttctacttcttagttgatacatattttttcactatttctttggcattatggaacacatttggtaatatcattcctaaaactttcaagaccagaactgtattaatggtcaaaaggttacacacatagccctcacggggaggaagaaaaagaatgaacatgagatgccttgtttatgttactgcaacactgctcagacaatcccaacagttatgttataaagcacgtaaccacgagccagctcctccttctcctcactgatcccaacgctgagatcatttgagtgggaagacccacaactattgattagttaacccaacaggggccgcctttggtgcaagacatctgatttatttttggattttaaatagtgtcaaagactggagaatccattaaatatctactatgtgcagaaaattgtgactgttacacagaactaaaagaaaacacactatttcttatgagcaggcacttatgaactgggcaaaagtacatagagaagctctgactcagaagccaacgcaggagcctcaggtaagcactagcaagtgattattcgccaaagtcgaaggatgatttaacaaatggaacgcgaggactctgtcttacatgctgtgaacatggctttcctcctggtgggaaggccactgggaagtgaagggctcggtgcggcggtaccattttcttcttctttaagactgtgtttaaccagtgtgcagtaacacatctctttctttctcttattgcctgtcaaacataaaattataggtttgttgtttttgtttttctgctgcaggattaaagaaaattctaaggttgtataactacaatgcccttttcattggaagccccataaaagaatttcatgacatctagcacttgattaaagtaacgaattaaaaccgtgtagctggttacttgaaatacaacctaaaaatgttactatccatctgcaaacaagagtctacaaaagcaacaaattctacaacaaccttaaaaataacttcagtgatgactgaaacaacatgtgtgaccaccaaagttaaaagtgccccataaggacagagggccccacataagaaaaaatacaaaaaaccatccacctaagatgaaccacaggaaaacaaaaaaaagtctcagaagtatttccacatttttacaggaaaagcagatcctgtgaatggctatcctctttaagaggggtgtcttggaagtcatttgtcacatatatatataatctgtctacaataagcattattttttgaaaagaaatgaaacttcagagagcacaggaaggtaatattgaggagaaagcctgcaccccggtagttttagaaaagctctgtaagggacctggtctttacacgcttgtgtgcaagtcacacaccagtacagaatcctgcgtcccttcaccgtgcacagagagcagctggaatggtgactgcagggagtgtccgccctttctttcttttatttttttttgagatggagtctcgctgtgtcactcaggctggagtgcagtggtggaatcttggctcactgcaacctctacctcctgggttcaagcaattctcctgcctcagcctcctgagtagctgggattagagctgcgcaccaccacacctggctaatttttgtatttttagtagagacaggatttcaccaggttggtcaggctggtctcaaacgcctgacctcgtgacccgtccacctcggcctcctgtccgccctttcttaacaccacctgggaacatccctttctttctccattgctcaaagacaatggtgcccacaaaagatatcaatcccaccaaagattcgatcacaggaagaaggaattttcctatctttagaggtagaaaaaagttctttccaaaaataataatcactagcatttaagattgcatattaaaaatgccagaccttgctcctggtcgcagctaaggctattttccttacctgtgcatacgcgctgctgacttgactctcacagagaaggtgcgtgcatcgactcgtgaaggtggggtcaacagtgccgccatgtgcctggattatctacacacaaagacccgaccaatgcagtcatcaatcactcagaatagaggagaattccaatttcaaataaggcagctattaaaagactctatcatatatttatatcatgtatttcctcaaagtatcaaggacatgtaacagttctatttacggacttttctacccagcaccatacaatgaaaatgaactccaatactctaaatttaatctgaattcccaggatacaagagaagaacaatggaatgcactccagggcttctcaagctcaatgtaactgccactctggaccagggagttctgggaagtgggggctgtcctgtacagaggaggatgtttggcagtgtccccaacttctacccaccctatgccagcagcagccccctagccgcgactactaaagatcttcagatactgccaaaggtctatggtgggcagatccacctcccttaaaaagggaaataaaaagcaaatcagaatgaaattagtaaatcccaacagtttcttctcaaaacacatctggttttctgggggaaggaattgctctgtgtccgggctgtgacagctgcacgaccctggacattcttcagaactcaaaatattgtacatggaaaaaggagaatctgacggcctattaggtgaaatataaactttaaaaagacctgccccctaagaaaaccgattctttcacttactacttttaagatgtgaatgtttatttttcctatggctaagcataaatatagtttaatgaggcacaggacaaaaccacaggttcctcacccatccctgcttttcactcccctgaagcacatttagcactttaagctgtttccactgacaattattaatatattccaactaacactttatattagttccttttctctagttttacataaccatctacctcctactgtggacaccgttccccccaataacacacacattcttcaagccttcctgatttggttatatccagactcttgtttagatcattcatcagtgacttaacacaatgtagcccagccacatggcttaatatggcagcctaagattagagttcctttctggtataaactttggttttccctggtgctaatcacttcctcatcccagccccccagaattttcccttttcttagttttctatataccttttactatttcattcccaaactctatgaaaaatgtacatatggtggttctataatatgtctgcaaattactgtatactcctccctctaagagttggagctttactcccctagccttaaatatggtctagacttagtcacttaatatggtggaattgacagtgggagtctcccataactcagtcacaaaagacaccataacgctgcgggttttccctctatcttgggtcacaccccctggggaagggagccagctgtcatgctgtgaagacacacaaccagccctctggagagcctctgtggtgaggagctgaggcctccagcccacagccatgtgacggaaccatcctggaaggggctcctgcagcctccgctggcatcctgactgcaacctcaggagatagctgagccacaaccgccctgccaagctgttgcaggatttctgacccacgaccaaactgagaggtaatgtttattgttttaagccactgggttttgagataatctgttacacagcaagagaaaatgaatgtagtatcacctatacttaagcaacacaggtgtgaactgtgtgggtccactgatagctggattttcttccacctctgccacccctgagggagtaagaccagcccctcctgtccctcctcctcctaggcccactcatcgtgaaaacgacgaggatgaagacctttatgatgatatacttccccttaatgaatagtacatatattttctcttccttatgattttcttaataacattttcttttctttagcttactttattgtaagaatatggtaatacatatacaaaatatgcgttaattgcctgtttatcagtaaggcttctggttaacaccaggctattagtaatttgggttttcgggaatcaaaagtgatgtacagatctctgattgcatgggggtgagcacccctaggccccacactgttcaggggtcagcggtacatgtctctcctcaatctaccagtgttttcgtttgcttgctcctcctggaagtctctcttccggtcccaggtctagttctctcgacacctactttctcatctattggcgtttccctttacctccatcctaggaactctctttcaatctctgagtcaaatgcctcatttcctggctaccatgtttcactctctgctggcatagtggcttcctaagaaagaatataagggaggtacattttttaccattagtctacaaatatcctccttccatagtcttatgactgataggctctataggttattttaggttggaaattattttccctcaaaaatggaagaagctgctccattgctggcccccgcgcactgcactggaggctcccgaaatcacccagactcctgatctgtccacgtttcccctccagtgagcttgtctttgagagaaaacagttttctctaccagcattgtgaatgttcccagttgccttatcatggctctccttacatttcttttcaacctgagggcacatggccttcagttgcaaagctattttctttcataatgttcttgccttcattttctctgttcccaagatcctatttaatgttagacctcttggataaatcttttaacttgaaaacaagacaaaaaccccaaacttttctccactaacttttgtatctttgagttttgttgtacttctcaagacagtttctcagtgctgccttcgaacacttctgacttttaaaaaatctctgctgctgtccttctcagaactgctcccttccttcctcaccctggcacatgccatccgcctctttcctcagccagccacacagtcatctccctggtcaccctcagattcaaccctttactatttaaaatgcacagctgatcacttcacctgcatctaaacttcaccacatggcacaccaacaaggtcttggaagacacaccagccctggctcctgccccaacccctgcctcgtggatcccactgaggcaccctcctttgcaccctcctgtcagtttcaccaatcacatgcctttggctgtgctgcactatttggaaaatcctcccccctaattctcactcctactcatcctataagcagttcaggaatcacctctcccagcagacttttcttaacacatcaccccacaacacgatgggtgaaggtcctttctcaggctctcacaacagcctgcatttgccaccccacctctgcttagccgtgtggctgcctctcgcactgctcttccgttttctccgtctctgtgatttcgcacatattccctaagtcttgcagcatgcttggcacatagcagggatttaagcactagggatgtttatagtgaagcacattcaagatatattagaggcatatttaaactcggtttttataaaaaaaattttttgactcagttttgttttggggaatgcaagaaaaagtatttcttttctttaaaggccaccatgcatgataatacataattaaattaactccagtttcacaattgggctggaagaatttgaggttctagagattccaggattttctaacagttacctttggagaaagagaaatgactgagatgcatacaaattaatagtccctctcccaggacaccaaaaccctgaacttatttccattgccccaattatacacatataattagtgccccctggaatttccaagctgaaaaaaataaaaagtccaccatcttcatctaacagctgagaaaactgatgcccagaaaagtgctgtgcctcaggtcacacagaatgttaatcaaaatgcccgtcacacattcagaacacgtgcaggtgcagctcagtgaatgcagctaagtgaacacagttacatctacataagaaagaagcatcttcagacacagtcatccttcctccaggcacaatctcacccttttccaggtggccagcagttgcttatcagacatctgctctggataatccgcaattgcaaacacacatcccaataagaagccttcttctggaactagagtaaaattacataagaaaaagaaaattaaaaccctatgaatatgcttgcacaaaagttaaaaagtggcgcctcacaatgtcaatctgttatgtttatcagtcttgaccatgacgtatctgccagtaatcagagtgcatagggaatattgctacgaagatactatttaactgtctacatcaaatgatcattaaaaactaaaaccaaggtaactcatgcctggccattaaataccctgaatgagtccctgtggcagcctagatgttctacgggacaccaatattcacttcaggatatgatgtcccaaagtacaaaagaaagcataattatcccatggtaactatattctttgttaggtatgagactcacactctccattttgtagtaattgttttgatatgaatcctcaccccacactcaaacactctcaaagcatttatgtgggtacaagacttttaggagagaggaaaaataatctccattactaactctccactgctggatcatgtccaaaaagctgatgctgctgaggcgatggtggtggctgctgttgctgctgctgctgcgggggctgctgaggtggaacctgatgctgcagcgcctgtgacgtctgactcaagtgtggcgctgtctgactttgcatctgctgctgctgctgctgctggtgcatgcgctggagctgctgctgctgaatctgctgttgctgctgctgctggagcaggctgtgctgctgctggagctgggcaagctgctgctgctggagctggtgctgctgcagctgatggaactgctgctgcagggcatgctgctgctgaaagggctggagctgctgctgagggcgatgcagctgctgtggaggatgcaactgttgctgtggaaactgtagctgttgctgtgaaaactgatgcggatgggcttgctgctgctgctgctgttgctgtgaaaatggatgcggcggctgctgggggtaaggttgctgagagatctgctgctgctgctgctgctggagctgcattatctgctggggctgaaggtgtaaaaccgggtgctgctgctgctgctgctgggcctgctgctgctgctgtagcatgtgtgtctctggagtcactttcacttggctaaacagcactgcattggcatttgtatgtccctgctggctgtgattcacctgctgttctaaatttttcgtaggtgctgaaagagtctgtaagatctacaaaacaaaagttaggtgaaacattatcaacagttcctgaaacagatgaatgataatttcttagtcaagagaatggcatatcctatttattaacaatattcaactaagtagacacagcaaatgattggaaactgcaaaaacaatactgcattttcttttgtatttattttgtaacgccaatatcgtaaagtaaattcatatattgagaccaccaaaatttgaaactacatcagtaaaatggagtaaactaacgaattaaagtgacaaagactcagacggctgatgtgtttgccagagcagggcatgggagtcctgtgcacacctggtagctaagccttggtgctccctgcaccgtgctgcggcaccactccactgcccatcgcctgcatcagctccgcagaccctctcctggcccaggaatgcactgaggaatgacaggtggtgaaggcatctggtaatcgggctcagcctcacctcaaaccttctcgccacagctgccacttcccatttcctcttgtcttacagcccagagtctagtaaacaaaggttctcagtggatcaccttccagatgaaagcagcatgacccaagctgtgagtccaagagcctttcgctccactgtcaacttgctatgtgcactggcatgctatggaaaaggaggccagctaagacaccaccggggctgtttaaatggtgatgttcctcccaactaaggactcatcattagagctgggaaatgatgcttcctcaaaaatgactgagtcttcatgggggacacaaaaatatttcaagctagaaaaaaagaattcaaaccagactatttgtcttctagctctttctgcttcacaatgacagggaataagctgagagttctgtgtacgctgaggagtaggagaaggacggtgaccagcagatgcccaccaagcagagtaagttatttttttaatatcctatagggcactgaatacaacaagagatacacattatacaatgaattttgttcaacatgctcaagcaacaaaaatttgaaaccaacttcttatggtcatggaaatcagtaaaaatagattttacttaactcaatccatacaacttttaaccctattaaaagcatttaaaatttaaataaaattctaggaatttaacacatatcagaactataccaaaatctcaaacatattctaacatgtatctttcacttaaacagattccaaattgcaaagattatatgacctgcaagggtaacagattttggatttagtaataaataagggagtttagaattgaaataagtcaaaatcaagagcttgggcacacccatctctaaaatcaccttatgtatgagacatctctataaaaggattcaagacttcagaaacacctgagtggaactctaagcagaaaaatgtcttttaaacaaaataataagacaactgtttcatctccatatttaaaagtatttttaaaaatccagaaaagaagatgggacaattcaccccacaacatgccaccccatggagcccagcagcatttggtgctgtgcaaacaccccctaagaagcatgcacgtgtggggcacctgcctgcctggtgggcaccagccatgagccctacacggcaaactgctggaaacagcggctgcctcttgagaaggtaaacagcagcgaggggtgggaggggggctgagagtttaactgttcactctgtcctttggtatcatttgaatttttgaattttgtacacatattactttttcaccctcatatgtaaacagcccatggaactctgagggatggtaaagaaataaatgcccgtctgcaggtggacagggctgaactagtcattaccaaatgctgctccccgcctctctgtacctgccaagcccaggtggaagggagctcaggaacaggcacaggacctagacaaacacagcagcagacatcaggacagcacagaggccagaggctcctatttttcagattggccaagaggactcagcagggtctgctgcctgcagaaagtgctccatctgatctcagagggctgagggaggcctaggtaggacaggaggcaacttacagctgtttctactacgggcttgagttaagatgggtcctcatccactgctgacccagcccatccactgctgacaggaggcaacttaacagctgtttctactacgggcttgagttaagatgggtcttcatccactgctgacccaccccattaagggagaagaacagatggagattcaggacaagagtcccggctaggaatgaagatggccgttggcctggaaccttctccacttgaggaagcgagaggtgcaggcctggatggagaggagaaatctgcaaggccagccatcgagatgcctcccaaaacccctaccacattcatccgatcactttttcaaccatctgatctgcctctggctggaaacatgttagtcctggagaacgtaagaaaaagaatcttaattgctcaattacgtaattgtgctatactacaaacaattctgaatgaatgtcaagtttaaatttttccatcacaactgtcataatcctcatttacattaatactgagttactgaatgccatatatagaaagcagtatgatacacatcacatggcttctaaccactataaatttgcaatttaaacaggattttgatggtaagttacactccccccaacaatctaatgttcaactaaatctgtctcatatttctaaagtttcagtcattttcttcacatctagaagtaaaacgtccttatgttctcttgcattgctgaaagtctctcagaaaatctccgcaattcttctcactagtgatcaaatccattcactcactagaaatggatggagccttctcagttttccaccgctagagcacacagctgagtatatcaaatttgtctcctaaggacaatttccagtgcagagatgtgcccaaactccctactgcagtcaattctttccatttcaaagtaaattattttgtctctatatccaaatacaaacttaaggaactttatatttaaaccaacatccattgtatttgaaaaacataataaggccaggcacggtggctcacacctataatcccagcactttgggaggccgaggtaggcagatcacctgaagtcaggagttcgagaccagcctggccaacatggcaaaaacccgtctctaataaaaatgaacaaacattagccgggcgtggtaatgggcacctgtaatcccagctactcaggaggctgaggcaagagaatcgcctaaaccagggaggtgcagtttgcagtgagcagaaatcccaccactgcactccagcctgggcaacagagtgagactctgtctcaaaaaacaaccaaaacatatatattagaaataagtagtaactaaccagcagtaactgaccaacactttttgacaccacagataaatgaaaagcaaagaaaatttcctatttcaaatggatgacttctgtccataatttctcacctaaagaaagtgagaaagtagccatttctcgaagtgccagaggcttaatccatgatttctcacaccaaccctatgagagagatctttacggcccatatctcgcatatcccactgctgacaggacaggtccactgcgtggccgcagtcttcctgccaggactgggtcaccttctcaattcctccacctcagcagtatcatcactcttctcatgactgaggtcaaaaatgctagaatcctctttgcctctagcctgtcattctttatggcctttactttctacctgtcatgacatcctctggctctcaggacgactgtgtgatcgtcactttgctgctctgtggctgaggctgtgccctgtggctttatcccgcccacctgcctggacgcggatgtgcagggaccagggccggcaccctcagcattgggcggtgctggagctggctccttctgtgcatctaccttttccctaaactcggctgaccccagcgctctcatgggcacccacctggacaatccctggccttgcagctcttggacctcctcatcttggtggccttctccccatttcctcagccacacattcccaaccacccccaagacccatggtcagtggcaggcctgttttcctccgggacccaacaaggtgacatggagcggtgggcactgaagcaggcccaagagctcctaacgggcagctgctgttcagttacaaggcactgtcaccacccaggacttgaggaaggccagctcggcattttatcaggcatccacctctcaagccagaaacccaaagtcttccctatctatgaatcacctatttgaaaatcttctattctcctcaaacccgatgaccttctctctctgctcaccttctcccccaccatcttaactgtctgctgtctaacatctaaagggcatgtttgcctctatcttactctggatgccagccaaccgctgtcatcatcccaagaaccgtgtactactaatactcgctgcttaggtggaggggaggggagacaaagattttgtctgtcccacagcatttctaaacactacgtaaaccactgctattatcatacccaataaaatgatcattgtcaacatcaccttatacctacgccatactgaatttccccacttcatcaacatcaagcctttccactgaaagtggatgtggagaatactggatccggcttcaggttgttcctatatgctacagagccatttttctgggactttgagctgtcattatgaaatgaaagtgtccagaacaaggtgaagcggcagacggggtgtcaccatcagatggaacagcccagctggctctcaatggtgcggctcctcagagcctggccccagaccctcctcttgctctgccccacctactacacattctcacatccgcctccacagcttcagtcagccttgttttctctggttccaccacgtagcagacagcccctgcatggatcagatacctccaacccaacacatctgaaaagaaacttaggttcttcaaacctgcagctttccagtgttccttatctctgaaacagcatcatcttccttcactcgctcaagccagaaagctggatcctcccattcatttttttctgtctcaaactccaactctatgtcctcttaaggggcctctctgcttcactcttgcccctcaaagatccactgtttacacagagtgcatctcaccccaactcaaaagcccagtggcttccttccaagaaagaccatactcctcactatggccctatatggcaaggccccttttaaatccttcctagaactcattcaccttatgaagttcaaatttcattaactttcttttcttagaactcagcaaattcatgccatttgggtcttccttttgcctgggaactctgtgccctcagttcttcacatggcctctccttgtcattcaaccctgatctaagtcacctcctgcccgaggtccttcttgaccatctcgtctaaaatagcctccttcccttcacctgctattacgggaccctgattattttctttgaaacacctttcaccatcaacagtccttttgttcatatttctccacttactgtatgtcttctctacctaaattagttttcttagtcacaattttatctccagtgcccagaaaaatgcagagtggccaatataccacctcaactaccttctttctgtcttaaatagaaatatatgtacttaaaacttttaaggccatgcgtggtggctcacacctgtaatcccagcattctgggaggccgaggtgggtggatcactagagatcaagagttcaaaaccaggctggccaacatggtgaaactctgtctctactaaaaatacaaaaaaaaaaaaaaaaattagccaggcatggtggcacatgcctgtgattccagctactcgggaggctgaggcaggagaatcatttgaacccgggaggtggaggttgcagtgcgcagagatcatgcaactgcactccagcctgggcgacagagtgagactccatctcaaaaaaaaaaaaaaaaacaaaaacaaaacaaaaaacaaccagcaacaaaacttaagatccactctgtatcaataagctccatgctatataaactgtaacctgaaatcaagccttcctcaacaaatgcatgaatttgtgttatttatttactaccatgaagttcattataagcaaatcaggtacagctggtaaacttcattattctctttgctgccattgctaattttaaactaagtaagagtggaaacccttcaacggatagtactccatcactgacatcctggttctactcagctgctttaaatcttcaacttaaaatacgctgttaccctttttcaatgaccctgaaatatacatatatacacatacacacacacacacacacacacacacacacacaagtaaacaggttctcacacaaatactgcttgtaagttatttggtctgaaaaagcaaaaccaataaactacattgaaatagactgtgaaatccaattctaagatccaatactgacatttttttcggaaagagtgacttacatgtgctacatttgatggccggttcatctgctgaatgtcagcattattagtaatattcctcagtgtccgtacagctggactccaggtagctatcatttctgatctttcagaactttggaggttttgtccagcagccattaaattaccccggacctcagggggcaaaatgttacctgggacgggtgggacattggcacacaagttaatcaacccaggctcctttccctgaggcagcctgcgttttgctgcagctaactgtgggacttcggccggggtccagtttaaatttctctcctgtttttccggtgatgaatctgaagaatcatcaaacattaattcccctttagatttttcagtgttggatttaggtgaaaactgctggtcacctgaaggagacccttcttgagagctggcagggcttgacttctcatctgtactaccctcattctgagaatcttgttcctcattttctacttcctcctcctcttcctcttcctcttcttcctcttcataaataatcagacgaggatgataaaatgcttcgtcctttttggttttctctgatacgcaatccagaacccagtcaggagtcacaattttaatacttgctcgctttaaagcacattcgtatttctcctacgaggaaagcagaaacacacacaaaacaaagctgtaaattttatcacatttcctacaattacgcattttagaaaaaactcagtcaaggaatgcagttgaaatgttgagcaactattattacaattttatacagaagcaacgtttgatcttttagacagaggacatgaggcaaaagtgaaaaggaaccatacagcagtgatcataggaaggtctcacacctgtagcaggagtcttaaaagacttggctgaaaattaactttttaaaatgatattttaagtacaaaagtagagctagtaatcctatggaaaattatgaaatgaataattgctacctaagtttttactgattgataatatttagaagcttggttttccatgacagttagtaaagtaacagcgtggcagagtgccgccaatgcatcacgtacactcatggagcatggctgacttggctgacttgcataggacagctctattcaagatccagtatttatggagctcatgctatatgccaagcagcactaagggatggagacacaaaggatgcaacaagtctctgacctaacaaggctcacaatttggttctaaagagatattaaatacggaatgcaaatacaatataaaaccactgctgaatgatgcagtaacagactggaagggaatctcatcaacataagctggagggcaggaggaaagccccgttgaaaggtgagctttggctggggcacaaatgatgacaatttgcacagttagaatgaaagcagaaaatacagcccactggaaaagatgtgtccggagtagtatgttcggcaagctaacagagacctctcctgtggtaaagggtgtagaatgtggaaggcacaggggagggaataacaaagaaagaggaaataaataaaaaatgttaaataagagtaatatgacaataaagtaaccttaaaataaatgagttgtaaatttggctgtgctcctaaaagcttaacacataacagcaattctctagcaaacacataatcagggccctaaactaaactccgtgtcctgttgcagagccccaaggtggcatttgcaatttctgggtggaataagagtcacacgcaatagggatgcggggcagcagcacagagaggacagctgttggtcattcggtcctggcagcgaacgccaggcattgcccatctgggagatccttgcaaatagtgagctctgcacacagctcagtgacttaacttgtgtttgtgagtttgttctttctcaaacctttttaaaatataagaaaaacctagtcatgggagacacccatgaataagaagctaagcaaaggaaaatgaatgtaatcataatcacactgactagaaaggaccacgattaacatttttagggtatagtttaaatttatttttgttataaatatatatgtacatatattaaaagggcaaagggaaaaaacatatagtcatagtgaacaaatactttataatgttcctttttcacttaatatattgtgaacaacctcttcctatgaaaacatgtatacttttatgcttttgtttttaactttttaatgtacattttcgaacacagaccaaactttttaatgtacattttcgaacgcagaccaaactttttaatgtacattttcgaacgcagaccaaattagagactagtggaataaatcccttgtatctgtcacccagctttaataactggcaatcttttacaaatcttgcttctcctgaactttgtttacggatctcaaattgataaagactttctaaaccaccataattatcatagcagcacaatgaactatgattcacctcatcctcaggccctattcagatctccccagtagtctcaaaggcttttacagtttcctcttcggttgcacagctgtgtaccttagttcatcccccagtgttagccacgtggttgtttccagtgtttcactactatgaaaaactgcagttatattttatgacaaattcctaggttttggtgttgaggtttgaaaaggaatagatttaaggcttcatatctctaactacacttcccttcccaaaaaggctattccaattacacttccaacagctatgtaagagtacatcaatttacctataccctcgacaataaaatgtcttattctttaccctaaaaaatcatgctgttcttaaatatttaaaagcataaaatgttatatagctctccccagatgataaatttctactagagattttcaatttctggactacccattccagaaaaacccaagttattttaggaaaatatgaagtccaggtacacagcagaatatttatgaaccaattaatacaaaaatatcatctgcttgaataacatatgactatatgtaatatggtttacatatgatttttccaagttaaaaagatatctgttgaaatagtaaaatatgaaaaaaagttatttttaattgttttaacaaataccaaaaaacaaaacaaaactactgccatgaagaggagtcactgaaaattttggatatgaaaaagataatttcacacttaaaaggctgggatccagtaggctcttgagttcctagtttgtatagaatgctggcatttcacatttcagaaataacttgactatttcctgtggaaatctaagtaaaacacttaggtaaacagccttactatatttcactcaagttttctctcgcttttcacaagataggtagtttttaatcactgaaagacagtaactgtttaaacaaagatgatttaagaggaaagcaatgtttagatgcctttgcctgacccaatttatcagctaaattattctaaattttgtatcctcaaaacttctaactcactaagggctaaggacctcaagggtcaaccatgtcccctctccccaacaactaataaccataccccgtttctgttggttttaagttataaattctttcattcttcttaatttgaaacttttaaacttcaagagtataaaaggtagttttattaggccatttgcacaagcttttgctatgtgctcattaaagaaaacaaaaacatttactttaaaaagaaatgttatttttgtgtacagtcagctggtctctagcactcataaaacttacaaattagaagaaactatttaaattcaccactattaggtttacaaatttatgtctgaatagattataaaatacaataatttaaaggaatgataaaaattaagtctttttaaagggatttaatttttcaaatatttgtggttattgagttacataagccacaaacataacataatcgtgaatcaagaacataattatattatgttaattataatgtaaataataattaatataattaatataaccattttggttttataaatagactatgccagaatatatggttccttcagttcattttatagactggtgcttctcagccttcaaggggtgagttagaaagaaccagggaagaggcgaggtgaggcagggaacaccacgccatagaagggtgcatggcctaccaggatccaacaggaatgaaacactattgccttaaagacaacagacagacatgagcatgaagtccaactgtcaatttctgatcctgtgatcttggctgaaactaacgcagtgacactaaagaagagctgttaccactccccgaaattttggaaatttgtgagagcctattgtatttgtcacaaaagctggctggaaggaaatggttgagggaatgctaagtcctagaatgatcaagacaatgctgcatagtcgaggaattaccctacaaacattctggtaacgtaccatcagtcatattaaaaaatatctggaggtatgtacttaattttccagaaaaataaaaataaaaataaaaggaattatttctagcttattcaaaaatttacaagttagtcagttttttttttaattgaattttattggaaactgtcactaatggcaatgatcacttaccctttatgtcatcattacaacagatatacaacattaatctttttttcgcagccgctatattgatgactgtaatatataaaaatatatgcttatatatgttatacatatacaaatatcttttattttttgaagcagggtctcactttgttgcccaggctggagtgcagtggcacaatcatggctcagtgcagcctcaacctcccaggctcaagcaatccttccgtctcagcttcccaagtagctaggaccacaggcgtgagtcaccacatccagctaattttttattttttgtaaagatggggtctcactttgttgcccaggctggtctcaaacttctgggctcaagagacctcccaccttggcctcccaaagtgctgggatttacaggcgtgagccaccacttctggcccatgtaatatcttactacttcattgtcttctagggtagttatgcttgagcattaaaaaatcctggatgtttttcattattaattgctctctttctctttctttacatgtgggcattatgccttcttaaaaattaagggctgggagtggttctcacgtctgttatcccagcacttagaggttgaggtgggcagatcactggaggtcaggagttcgagaccagcctggccaacatttggtttctactaaaaatacaaaaattagtcaggtgtggtggcacgagcctgtaatcccagctacttgggaggctgaggcaggagaattgtgtgaacccgggagatggaggatgcagtgagctgagatcgcaccagtgcaccccagcctgggcgacagagtgagactctgtctcaagaaaaaaaaaaattacttaggaatggtaatgtgtacagaacggggttagagaaaggagtggtgggtgtctgtgtttcagtttcttcaaggggacagcaggacttccttcactgtacgccgcaagcagcactgtactggcacttagtaagtgctcactaatggctgcgtattagtgttatttttattactggcagatacaaaatctgcttttaacaaatatttaccattgcagaagaaacacagtaagcattaaaatagtagttcatttttccctatgttgaattagttcatgtaaaactgggaaattaaaattggaaaagcaaaaaaagagttatctttcttttccagtccataaatgaaatcaagaatgaagaacaaatacattacataagacaatattataattccaccattgacttagataagataatctctatatacatgcataatacattatatatatcacgtttagtatcaacttttaaaatatatggagtatttgctttatctaaatgtaattatagtagcatatttgttgtcttattcacaagcatgttttagccaaagaaaaatgatttaagtgcctctttgttgggataaataaagctcaattaaagtatttatatatagaccttatgacttagatttgtttttccttccaaataaaaattttaaaagattccatttttagctatacacttaaaaaattagtctaaagtcaataaatactttaaaatatatactctatcctaaagcccaaagaattactaaggatttctcatcaaaatattttggaaggggaaaaaacgctaaattaaggcactagaattaaaacgtcaaatcacaattcaaaaccgctttgacaaacccactctgttcacacagtgcctcttaaattgtcattctaaatcagtgaaaaaagctaaaggtttcatttccccttcaaattaactatgtaaaaatcaaatacatttttgctataaatcaacattaatgtaaaaagaacccactattttaaccaaagcatactgtttattacttaaactgtcatggaaaatatgttttttacttaaattttagaagtcacatgataaattttatataatgctttctatagaacagtggttctgaaactttagtatgcatcagaatcacccaccagaggacttgatcacacactgactgttgggctcatctgattaggtctgggaagaggctggacagactgcatttctttttgtttttttgagacagagtctcactcggtcatccagactggagtgcagtggtgtgatctcagctcactgcaactccacctcctgtgttcaagcgattctcctgcctcagcctcctgagtagctgggattacaagcacatgccaccatgcctggctaatttttgtatttttagtagagacagggtttctccatgttggtcaggctggtctcgaactcctgacctcaactgatccacccacatcggcctcccaaagtgctgggattacaggcatgagccactgcgcctggccaacaggctgcatttctaacaagtccccaaggggggcagatgctgctgatccaggggtcttacttgtggaaacaaaatccatacagccacaccactgctcaaggatgagagccctatgcttatcaagacaaaagtcattttcatatattccagattatgaagaagaaaatatatagaaaatttcaccacacacgtttataattatacctgatacaaggttcttaaaaaaaaatggtgacgggaactaaaaatacatttttttaacaaataaaaatgaaccaaagttttactggatttgaaaggaaattctacagattaataaaattttcctgttttccgcataaaatgaagcaaaatttcatagtatttagaagttatatttggcttacaatttacaatcatctcacatcgtttgtggaatgaagctggatataaataatataaaccaatataatcagcttttgtaaatgaaatataataactaatttaaaagaagctcaaaaaagacatgtgattactagaaattcttaaatgacatacaaaaagaaggtggcacaagaaacgcttaccccctttggctctggaacaatcaaatgcgtgcatttcttattgagggttagctggcaatctcccccatagaacgtaaccaaagcccacagggcacttctgtcttcagatgacacctgacagaaagttagaaagaaggcttttaccatacatttcaatctgtgcatggctatattttcactttagtaatatactgcaacaattctgtttctcccttaataaaattaacctaagaatatttgtagaaaaaatagagaagcttttagctatctgcttattataacaaaaacttcactcctatcataatagttttacatatatgaattacttatttttgccttgtcaccaaatgaatttaaaaatatttatatccacattccaaaaagtgaaatggaggattatttcagtctataacaaaaatagtcaggggaaaaaaagcaggaagaactagtatgccattccagtttccatttgtgtcacttttgaaaatgtttaaatacaacagcaatatcaaaatcgtattttaggaatgcctttatgctaatggataacaaatactaattatgaaatgaataaaataaaaataaagataaaaatatggtggcttgtaagttcaggggaaaatgtaaatattacttaacacaggaaagaaagaaggcaagcataaaaggaataattcttatgcttgctcagtgatgaagtaacgactccagatacaatggcttatgcagtcaaacaggctttcactgtaacaatagaaacagctaccatttattgcctgcctactatgtgccaggaactgtgccaagtgctttatctatacagctaacccttccaaccgccatgtgaaacaggaatcatccaccccattttaaacataaggaaacacactaaattacacctaataattggaaaagctgacttttaaaacccaggtctgtctacacccaggtctaactccaaactggactttccactgttctacagtgcttctctaagggcagttactgctgggaaagtcaaaaataatttctaaaaaaaatgaaattttagagtctgaaaagcaaaagaacatttaagaaaaataaaaatataagcattaattctaagataatcatttaaccgagtaaattttttctggataaatttattgtaagttgaggattatagttgttgaagaatcctgaactttgtctcgttaattttttaaaagtattgataatagcatgttaatctctttttaactgccagtatgcagcttgccaataatctagcattgttcatctactctcatccattttacaaacatttctagaaattattctgtattacacactattctatgaatattaacaagaacatgttagctttctaaaaaacacttttcaaatcattattttataacttgttaatttagtaagtcaatgtcacatttcagaagactggaccaggttatttttattagaggctttcacaaaaacatttatatcctgcagcattggagagttgagatttaattatatgataatacagattaatccaatgagtcattatctaatctttattaaaaatgaaattaaaaaacaatctagatatgcctttattaccaagatttgcctatctgttcagttaagtattattttattttactgactgcagtaaatctagtcctataccctatttggcctgtgtcacaggcgtagacctcaacagggtgcaggagattgctgtggaaagaacatcagctagggaggaatggaggagacctggcattaatacgacgcctccaataactcgcttatgtcaacttggaaaacttccatgacccagattcttcactgatgtacgtttggattaaatgactttgaacatccataccagctcatttaatgaatctccaccagcgtaattaagaatgctctttccacaccaaaatgttaacaatagttacttagtggtgataggattatggggacatttttattttcatttttatacttttctgtattttccaaattttcaaaagcattaattttataattggggaaaagtgcttttcttttttaaaaaccatctttccaaaataccaatgttatcatgttggctaataatgtctcctcagtgctgcaaggctaaaatccaaaggctcccccatagtgtccaggcccttcctgtctggctgctcctaaccacctcctcctgcccatgagcactgcccccacgtgcacctgccgtcctcaccacgttctgctttcctgtgccccgctgcgcccaccctccgacctcctcctctaagactcagctcaggtggcattaccactgtactcccacagcaagctggacagaaatctaaatacttctcacactctacaactatctgcttgcttatctgtcctcccagctatactccaaagcaaccaggagcagaggactagaatttcaagtctgtgcccccaggaataaaagctttcctttaaaccaatcaggaacactctcccttttccttcttcaggcctcaccacccccaataagacactccttgattctagcttacaggattttctccttgtccagtcttgactatgaactctaacactccttcttaaagagtcttacatgatgtcctaaacttctctgagatctttcacagcacctagtacagtgcaaggcacatgggtaggcagtcaagaaatactgttgattgagatacagaatggaaaggactttttagtcttctagattcaaatcatgacctagccaggctctccattacactcttgacctattccccaaaacctacccagcacattacaacagaggcctcagcctgcatcaataccgggtcagaagaaggcagatgatctctgtgcttcccaacttctgctggacaagctcccttccctacctctccctgggagagctctggaagactccaacaaagagctccagcttgtatcaacaccctgacggggaaaagacagaaggtcactgagaaccaccaagaaacagtccttttgtaaagctggggtcctgcctggcgtgtgcatgtgagtgtgtgtgcgcatgggtgctccagtgtgcagaaaaggtgcagatccctctgacagtctccaatcagttaggactaaccactgtgagcactccctcctgcttctgtacctggtgcccactttcatttttgcatatgttgcaacataccgtatttgcccaaggcctgacccctcctagactgtatgtttactgagagagaaatcgcatcttaattaatttgtacccctctgcattgctcctgtcacaaaggaagtacccatcaaggatttgttggaccaaagtcccttagctgcacactgtacatatgttgttaatgtatcttacaaccaaaataacattttttagcaaccacaaaatattagtgctcccaatgcacttttcttaaactacaatttccagggtttcttcatagaagtgactattaaagtcttccccatccctatttgaacaatctttctcaacttaaaagaaatgcttttattttaccccatgacacactggggattccaattcatcacgctaagtgatgaactgcgggaagtacagtaagtgacccacaaagatcatgctatttctggattctgatttttcttatccactgaatttgctaaaaggatataaaatactatcaaagagcttgctaagaaattaaccttttggccatcattgacccagccactccccttggtaagtttagcaccaaggtaaaattggacctttcacctgacagtgggtgagcagagccccttcccagaacacacaatcaaatgacactattccactgcaaagaatcaagatattcaccttctctgagcagtctgctcacctagttgtttctttatggatatccatcctcctatccccacagggactacactggtgacttctcagctgagaatccaagatctacttagaccccttagcctgtgtgatgctcactgagccagctgatactcctgtatcactttctatcatccttttcctcctcttcctgggtcacagaataggactcaggatacacacaaacctatgtacaactatcttctaccaatttatgctctaaatctttacctgggttgttgttatttcccagcaatgaaaataaaaatgattaagtgtgactttaccttggtttctaaaaataacgtcctcctcctccagtatcatctctgttttcaagctccttctttttttcctccccaaatctctctaccaatgcgtgctatccaaggctctactcccagttatctgctcctctctctatcatgctctgcaggaatctccttcatgccacagcagctccaagttcctacacttccataccttatcaacagcccagagtgtgtttcaaaccagtgtcaccatctcccctcgccaatcaggctcctccctatttcccagctccttcagcggtgctgccactttcctgtgctcctcgactgaaacaatgacataatctttggcatccaccatgggatctggcacagggaggtatacagtgagtgctggcttctcactctttgcaccacagcatcccatgtccccaatacctgctgagtcccatctgttgctaagtcccatgttgtatctgctaccctgaatcccatctccatttgtcaaaactccagcctctgtcctgccctgcaagtcatcctcagagctcctggaccagttttacctgcaatgatcacaagtgattctaattttgtttgacttttggtttcccaaattttctgaggtaagtatttgtaatccaaaatcaatgagaaaaaaagggtgatgaagcatcctgctacctactttacccagttcaaactcatataccttggtttcccatcgtctctatccatctacctgcctgaccattttttcttctacgtgcaaatgcacacccttggttgacaccagtctcctcttatctagcctctgtgtactcctgacttctccttccaccttgctctatgcagaatgccctcctcccttcccatttcctccaattctgtccattctttcagggccactcacaccttacatccactctgtcaaggcttccctcgcctcgcaatccagaccaatgccatccttcctaagctcatagaatcatacctgtggcccctgagtggtcatatatgtatcatgtatgtatgtctacactataacctaatttattacatgtataatataacaatttgttacaaatataaactctgttaaacataactattagttctttggaagactaataatattcttttgtgctaaactcatagttaatatttaacaatatctaattacctcatttgaaaccctataatcatcttatactcacatacttttgattttcttatttatttcaccaaatcaagtcttcaaaatcccatgtcactgtgaccttcatctctgaaaaatgcccataggactccctgtccctgtcccaaactcagcgtggcccttcgtcctctctccctttctcattcaattggaatcatttctggatagtcggctctgagtctctgaaacccagaaatccaaccagtgcaaataaaattaaatgaaaaattcacattttagccaaagtacattgtgtttatacataagtagtaatgctttcatttttaaaacttttctgataagttgattgtaaatttggaacatacagagaagtagaggaaaacaataaaaattacatgtaaccatagcacccagcatttcttttctcattttagccaactttaaagatcattcatgtaaatatacacttataacagatatgaaaaaacattgcaaaatacaaataccaacaaaattcctgttaaagagaaaaaaataagccaattttgctacttgaaggatctccatcaaattaatgtcacaaaaacaggattttagagaacttccagaatacaagagacaccaacaaaaacacagtaaccacagataaatttacttattacttggacagaggatggatcaagttcagaccggtgatatcctttgtattaactgttgagtctggccaacaacctaacaatgctaaaccaaatactacccagctccgtaatcctctatcacaaaggcataaggaaaagcaagattataaccaaatttctttccatcttacctaataacttgaatgtgcccttttctcaaaggtgtgcacagaaaaagatgactaaatactttttcaaaagtatcacctatgagcaccaaaatgacagcctgggatgaggactgtcaggtcaaataagatgggacatcctacagtgcactttcaccttcctaaggaccactaattttaaacaaattattccacgtaatttgtaaaacgactttaaacaataacaatttgatttttttctaatagtttttattatgatttgaggtttttcttagctgggggttagaaaaacaaaatacaatacaaaaatattaaatattcagatactcagaactaaccactgttaacattttggtttctcatttcagatattttatctggctggtgtaatattgtacatacctaggctatggcctgcttttgccacttaagacgtttcccatgtctttacaagttttcataaaacagaattcaaaaatggctaagcagctagactactgtgtaagtatatacaataggtttcttaaacattcccaaatagtggatgatccgattgtttccaattttaccatcttataaataatgcttatcaataaatgtaggcacctttatgtgtcagtctgtccttctatcgacttgggataagtttctctttttttttttttttttttttgagatggagttttgctcttgttacccaggctggagtgcaatggcacgatctcagctcaccacaacctccgcctcccaggttcaagtgattctcctgcctcagcctcccaagtagctgcgattacaggtgcgcaccaccattcctggctaattttgtatttttagtagagacggggtttcgccacgtttgccaggctggtttcaaacccctgacctcaggtgatccgcccacctcggcctcccaaagtgctgggattataggcatgagccaccatgcccggccgacttgggataagtttctaaacataaaagaaatgcaggtgaaaacgaaatgagtattttaaggcttgacactgctcccctttcctaggaaactgctgtactcccattcctgccggcaggaagcaggagtctgtcctcagcatctccaccaacactgaacacactgttacaaattcgatgagcaaaaacacttatctcattgctattaaaatgttcatgtttgattataaactgcatcaaatgttttgttacacttattagtaattcctctttatagattctaaatttgtttctctgccttatctgctaaggtcttttttattcttgttgatctgtatgatccctttatttattaagaaaattctttgcctgtatttctaactgaattttccttgtcatcttttaatttcatttttaatattttttcatattcaagttttaaatcttttttatttataaagaccattttcacccattaaaaactttaaatcttaaaagcaagcacaaatatttaaataattttaagtgtcatgagtttatattaaatacacagtcagtttagaaaatagcttctctaaaactggttaacaggtcataaatccaaccatacaaaaactcagaagtgtcacatataaataactcaagactaactgtaaccatgcttacctgagaaaggcaggcagtgattccaaaaaaaatctgacatgattctggagaaaaaccatttactctgttttatagttattaagattacaatgaaataagattagtgcaacctgtacttcactaacagacattacccacccactccgtccccactcagtccatttaagaaagagacagacttaagatagacaaagaagagtacagggcagagtggaatagagagtagtgggtggcacagaaagaactgagtgcttttctgtaaagcacattttgaaatccaatctctccacttatatcataaatcaaataggcaaagtatactcacagggggaagccttttgatctctgatagctagctaactatatacaaatatataaacacacacatgcctatacacatacacacaaatggcatagcagttattttaaaagcaaaattaaaacgtcttgtttcttttagattgaaacgttgtgactgcttccactgcacagtaggaagaatccttcataagagcttgattgagctctagttttattatctccgctaactttgtgaacttaggcaagacaactgtgagcttcaatttccccttttttaaaacaaaagttggaatatatgattccaaagatccttcctatttctaaagctgatcttaaaaattcattcaaaatgattaatgagcacttactacacatcacacactgtgaatttaacaagacacaaggcagtcatgatctctatgtgcctgtaattcatagtctattcagagcaaacaatgactttttttgaataatttggagtgtgtagaattcaaaatgggttaaagtattacttctctttccctataggagtaaagtatactgattgagataggtgaatcaagaaaaatatcagcttaaaaattctattccaagtttgaagtctcctatatggttacacagatgaatcctataaacatttgagacttccctggctgtaaaaaaaactctgaagactgcaatgataccttcagccccattatcgaagatctgtttccatcttccaacctaagctcatggattttctacttccaaagacttggggaaatattaataaaggcaaatctcagagtgcactgtctaccagtgagtctcccaggctcccttgtttgtttgtttgtttttgagatggagtcttgcttttgtcgcccaggctggagcgcagtggcacaatcttttgttcttatggataggcaagtaagagctcaaagaagatcccagtggctgggcgcggtggctcatgcctgtaatcccagcactttgggaggccgaggtgggtggaccacaaggtctagagactgagaccatccttgccaacatggtgaaaccccgtctctactaaaaatacaaaaattagctgggcgtggtggcgcatgcctgtagtcccagctactcaggaggctgaggcaagagaatcgcttgaacccatagtcccagctactcaggaggctgaggcaggagaatcgcttgaacccaggaggcagaagttacagtgagccgagatcgtgccactggactccagcctgggcgacagagcaagactctgtctcaaaaaaaaaaaaaagatctcagcttcttaaggagtcttgtacagagaataaatgacctggaacaacaaaatcagcctcttagctctattcccagtctttttgacttcttataaaagtaataaataacgacaaaacaaaaacaggaactaatttccttcaactctttaggctatgtacaagaaaatattagaacttctgagttggagttgctaaagttctacacatcctccaagaagaactgcttgtagaggaatgttttccctatttctctataaatatttcatgataagtttccttccatctgcattgattcaatgggtaataagtgctttcaagagaactgcctggcatagctgcaaaataaaatagagcacatgacataatctcttgccaggtctaaaattttagcaactgtatggtatcaggtacttgcaaaagaaatgatttccacaagcaagttacacttgaagtaacagtcccatgaagaattatccttttaggatgaaaagggagccaccaggcctagaagagtaaacaggaggcctgtagaacgcctcatttctgactcctgacacagtgccagggcaagggcacatctatgaatgctccatgaacgaacaatgcaagcaaggaagctccctgagggcagaaatggtcttcttcacccctctattttcagtactcaacccacagcacaggtgcactgaattaataatcgttctacccaatgcaattaaaaggattaacaatgcatgttataaattttattctcatgttctcttccccaacttactcttcaaacaattcatgatttgattcacatagacttagaattttagaaatatccctcatctagctagcaccacaaaagctgaagagaaccggagctcctgcctccagttcccggcctagagttacttgtcacagctgagcccccttttaacatgagtaataacaaggatcaggtacataaaatttgaaacaggatggaaaatagtaggaatataagatgtagacaaaacaatctgtcctaacgaatgaatccacttttcactccattaactatcatttctttcagtcttaaacccagagttaccctttccctcctcccccactcaaaaaaaaggatacggcagaagagttccacactgaacggacagaatcacccaagaaggctgaaaaagaaaagattaaatcaaaaagtattctcaatttacaagtggcatattattttactagtgttgttcttagaaattaaaagtctctgttacaacctattttaaaacatccagattacaagtatgaatattcaaatagaaatattatagtcaaagattagttactaatacccaagatgaaaaatccaattacagaatgaagcactaccatatttttttaaaattatgtataaacatttaagttccaggtttacacacttattactgctgacccccacatttaggacaggggaactgccacccatcctgccccaccaccgccgacacctcatccagggcatagtcagcctctcatacgctcccttcttgaatcccaaattcagtcaagtctaaattcatgaggtgtttgtttgttttagtgaagtcaagcagatacaatgtttgtaagcctgaaaatatttttataaattctaaaaactgagattaattataaaacagattaattactacctttctgggtaatttatatttttgaaaaattatcttgtttctatgtttaatttttataattatacaaatcattctcctgatagctctacttcagaaaattactatcaaaatgtagtaatgcccccattactacattctggaaggcagctgacttccagaaacttcagccaactgaaacagacatatatactcactacccacccatcaattcattcatcaaatatttattgagaatctattttatgcagagatggtgcaaggcgctggggatgtaacaatgaaaacgagaaacgcagtctttgctctcctgcaagtcatattccaagctaatgatcttcaagctatttttgtcatgtacaccttaaataaatttcagacaatgaaatgccccccttatcattttttagatgacatctaaaatttttcagcataactctaaataagtatattttctgtgagaagaggaatattaaacattttataaaataaaataaagattggcagctgtgcctgggataattacttcattatgatttgacatttaccaaaggttttaactaagttactggattagttatctgaaatctgaaagaaggcacttaatttttcgatctatgtgccttatccaacatatcttcacattttttgatagtcctagaaaaattccagttaaatttaaaaaaatgggccagcatcaggaatcggtattggccttgacacttctgaattcagaacaccttcatgtagaccaagctctcctttcaacagcaacacccagaaacccctctctcctcatgatgccatgactgagcactaagggaacagtccctaaaaccagtctttctaattgtccttttgtctgctgtccacgagaattttcagagcctggggcaatgcactacaagattaggatgggtgaaggtctgattcttcctgtgtaaagtgggaggggccactgtgaccacaggtgtgttctcaggcagctttaggaagggccagtctggaaatgttatctatcaccttacaaccatccacacagcatacacgctgaatatctccccccagggagcttgggtagggtatcccagtttaaagactgctggctatcataaagtcccatccaagcacagtagaatcactgaggccctacttcagataagtttagataaaataatgcaaaattaggatgtaggccacagtacaaagcagaaatggagaactacaaaagcaaagtgataaggaactatttatcctaaaggcaaagaacaatatataaaaataagctggctgatcgcgatggctcatgcctgtaatctcagcactttgggaggccaaggcgggcggatcacttgaggtgacaggttcgagaccagcctggccaacatggtgaaaccccgtctctactaaaaacacaaaagttagccgggcgtggtggcacacgcctgtagtcccagctactagggaggctgagagaggagaatcgcttgaaccctgaggcagagggtgcagtgagtcgagatcacaccattgcactccagcctgggagattctgtctgaaaaaaaattaaataaaataagcccactacaagtcagcaaaattaacatttccaatgatgcccaaaggccactgagaaaaatatctcaatttaaaaaataattttaaaagttttggtgcccaaagaagcaagttttaaacatttataagattcaaatatgtaaatgatagataaactgtcactgtgtataaagatgccttatttttaaaatgcattgtcaaacttcctatcaaggtaaaggccaagggatatgcctctagggaaccaggtctcagccttcagtcatatgaattcagactcaactattagcagcaggatccaaaataagacaggcccataaggttcaaactaagaatatcaggatctacttgaaatatcttagagtgaaggcaaactgttgagtcagctccgaagtactctaccaccttgtaatgtaacacaatagtccctggacaatacaggtgctgtcaaaaattacaagcaggctggaatgctactgggtacagatgaaatatgtctgtcactcattttaaaatactatagccagagggggaaaaagttgggtttgaatacagtaaactaccttggcaaaatggtgataatcctagatgctaactgctaattgtataagtaatgggtatttctacttagccttacatactgactttcccaggaatatgaatactgtgtaaaatgaaggaagactgctttgtttagctcaggaattgatcaccattctgaaatgtcacctcacagcggcgaccccacttgtggggtatgatatcaatctgtaattgcagcagctaccggcagtgactctacatatagcagcagccatgcccaagtgtttacacattgaaatatatatttattatttacttgccttttatttcgccttcacatttcagtttgggcaatttatatatacatattttaaaggttggcttacgtatcgattcatttctggataataaggggagtgctacaaagtacttattacaaaaaggtggtttggggtcaggcaggtttaagaactacttctggtagttggcctggcaacaatcacctaggccccaaggatgtgttagaaagatcaccctttcacataacatctgcataagatatgcaaagccgctttactgagacaatagctccaggctattgtctgagagaaagaaagtttgtaggaaggagaaggaagagacagagatactgtccctaaagcagtacaaggaagcaagccagagacaaaaacatgttccaaagaagagggtgccccagctcaggacctcatccaaggcagtttccgaccctgggtaccagggaggtcaccacttcccagcagccaggtggcttctctggccccgcaatttgacttaatggcaatctttctatttttttccctttttctttttgtttaagagatggtgtctcactgtgttacccagactggagtacagtagctattcacaggtgtgatcacagtgcatggcagccttgaactcctggcctcaaacaatccttccacctcagcctcctaagtagctgggactacaggtgagtcccactgcaccaggctggcaatctttcttaattcctaacactgttattgttaaaccacagtaactttcatactgatttctttttaaggcaaagcatttaataacatgaagagggaaaaaatggtagtggtatagaactattttaaaacaaatacttcatagggaagatctgaaataaaatcgaagcattggaattacaaaatttaacaaatttttaaaacacacattttaacagaagtcaactaacttatcagccataacataatacagtaggtggataaacaaaatctgaacaattcttccactagctgaatccctcattctctgcaataaattacccataggtcaagttggatacaccccagacgaccagtgggtagacaatgtgactaaaggccattgtgactcttgtcagaaaggagttccacaacatagttaatgggggacgcccttcagctaactgaaattcagaacaccttgccacagtcgggatggaaagtaaccctgtcctagagttacctcccgacaggccttagcctgcttttggaatgaaatacactcttacaataattcaaacacccatctgattcaaggcatcagatctgtttcccatgacaggtttccctggctcagaaaacttccaggcagtggtaacgtgggacgagttctgcagcaggcataaaggatggcctaggattacttacgacatacagaagccatgctctaccttggtttagctgaaaggacctgaagctaagggaagttactcagacgttaaagatgtccacagttatctggcaactttccacacaaaacaggactttagggccagcacggtggctcatgcctgtaaccccagcactttgggaggctgaggcaggcggatcacctgaggtcaggaattcaagacaagcctggcccaacatgttgaaaccctgtctctactagaatacaaaaattagccaggcgtggtggcaggcacttgtaatcccagctactcaggaggctgaggcatgagaatcacttgaacccgggaggcggaggttgcagtgagctgagatcgtgccattgcactccagcctgggcaacagagcgagattccagctcaaaaaaataaataaataaaaaataaaaataaaataaaacaggactttagcaaaaaccctgaaaagagctatagtgaaacttcaatgtactgcttgcaagatactgaggaaaagatataaaacaaattatgtttactactgacctttacaacaggtaagtcaaagacttcccgagcttctcccacctctggattgtccccatcctctgagattatgtgtgaggctagtgcattgtaggaaacttccttcgcttttccagccttgagaagctgaataacctaaaaaacaagaaaatccacacaaattaaaatgggcaatactgtactgtactcttgaattacagaaataattattgggcataatagtactttttaataaaaacacaccatattccccacataaaaactaacagccttttactctgaataatatgccaatgaaactttcggggacaatcaaaagcagcaaatcttgattcactgaccaagtcaatgaccaagtaatggaggctattgtgagtccagtagtggacatggtctgtcctcaagacagatgggctggacaaaccaggagacagcacaaccactgctgcggtggggccacgcacatggtgctcctgagcttccaacttaaagactgggacatggggagtttcataattagggaaagattctggaagacaagatatgtgagcagaaccctcataaacgtctgggtgttaggcaaaaatccatacatcgaggaagagggagcagtgttgaaggcactgaacaggtgaatacagagcagaccgtaaatgggctttcttacacactatgcaaaaaagtctgtgcttcattctggggtatatgcagggccactgaaggatttcacacaggaaaagtagcacagatttcatacaaagatgacagtccatgtgaaaagaaaggattgggtgggctggctgtgtttggttggctagatgactaaagacaagagacctgttaagaaacaagtgcaataacccaggtgaaagaggcatccactaaagtgatgtcctgatgggcagaaaggaggaagatgtgagagaatcggcaagccttggtgtctggaaggggtataagcaaaagagcaaagtccagactgaaatggtggtgagtaccactcactgaggaacacatcagaaggctggcaggtggggacacaaggacgtgttttagtttgggcatgccattctttgggggtcgtgttaatatctggcaagaggcatccagttgcagctaggaaaagatgtggatctccctgacagaaagtcatcagcattgttacatagatgggagccacagccatgagcgtgaaggtggtcgcagtgcagaatgggaggggagctagagagcagacacagcaactgatacttcagggacaggtagggaagtgcagtatcacaggagaggagcgtcaacagaagccaaggaagtgagggttaaggaacagtcgacagtcaagtgcttcagaagaggtgggcagtgtctaagctgacagtgcacaccaactgtcaaagtgacatggtgcccacaaagctcaagtgacccaccagggcaacgctcttccaggtcccctctctgcagcagagagctttcttctttcacttattaaacttttgctccaacctcaaaaaaaaataaagtcacccacaagctagacaaccttttcagaatactttaccgaccactaatagatatgaactagagcagaggctcaatatttagtaagtgaaaaaacagcggtcactggccatgggccactttacctttcttccttcccttgacctctaagcatttttagcttcacgcatccattcgactggtcttcagaaaaggcacccctccttttcctatcctccagtctgtttctgatcctactcccttcttcatgagtttccctgtccatagctatgttccctccacctgtaaacagtaaagtcacccacatccttccacgcgcttgtgatgcaacacagatccctccccagccctctcttcctcaggcaccttctctatttccttctcaggacaaacttcctgaagagtctaacctttctgttctcagtttccattcactcttcaactccctgcaatccagccccttccaccaacactctaccaaaaacactttactcggttttcacgaactttgaggatgccaaaaccaatagcttctcttcaatctccacactactgagtatcttaatagatttatctcatatcactctgttccagatatagtgatcatcctgatgtatcccaaacgcatgaatgccttcattcctcagcacatacgctccacatgaaaatattccttcatgttcttaacttctgcttatctcaaaacccaactgaaatgacatctactgagtgacatttcagtggtgtctactttgcaccccagtggagaaatctgctacaccttgtactgtgatatgtccaggtgtgctccctcccccaccaatgaggggcgctaaagggcaggtaccatgtcctcttcacctctgtattatacctggcacctagtccatgcctgcctcatattagatggtcaacatgtgaacttataatccacagtcataagagtcagagaatcagatgtccaggctcaaaacttttcagaaaatatactgtttcagatgaaagtggtttgccaaggacatttttaagcacttagatttgattcaaagtcgagtaaatatggttccagttcaacttgttccaggttttaagtaacatttggttcaagtcccctataagagccaaagtcctaaaatgaaacacgaaggctaggaaggagggggaagagaaaaatggtggatagcaaaaaacaaaaacaaaaaaacaaacaaaaaaaagaggggcgggggaatcatcaatactggaaaaagctaacactgttacaggcactcatcttcatcgctccgtgttcagcaactgttttactctgtaaattcaaagatagaaggctttttttttttttttgagacggagtctagctgttgttgcccaggctggagtgcagtggcgcgatctcggctcactgcaacttccacctcccaggttccagcaattctcctgcctcagcctcccgagtagctgagaccacaggcgcccgccaccacgcccggctaatttttgtatttttagtagagatgaggcttcaccatgttggccaggctggtctcgaactcatgacctcaggtgatccacccgccttggcctcccaaagtgctgggattacaggggtaaacccggccttgaagtctctttaccctaaagttacagggcaaaaagggtccaaaaagttgttacaaggacgaacctcaagaaggccaagatcactcagccttctacaattccttctacaccatccaagttcatctgcgaaatatgagtctccgcccttccaggcctaactctgatcactggggatccccatcctccaaggtgggggccactgatgtcacacccaaggcaacacaactgtacagctaaacttttaagaaggaaatattttgaagattaacctgaagaggatattcaactaagatgcattcctaccacggactgataactgtgtgacatcaaacagatatattattataggaatactaaggaaaacccacaatatcctttggcgtgagcccaaactacacaaaattaaatgtgtaatgtgatggtgttaccagggtaccgtaaaattaatcgtccaagtgggaaaatcaaggaagacgaatgccagcccccacgtgcagggacacaggctggaagggagcgctcctcagccccgcacaggacggcagctgcccgggtggcggaggcggccaagccggtgcacggccacgacccccgccggccgagcgaggctggggtccccgcgcgagctgccccggctggggatcccggcgcccctcgtccgccctcggagctgctctcccgggagccgagacgcccggcgcggggaatggggagacgcgaccccgcgcccgtcccgctcagcaaaggagcagagaacgaggcggcccggtgggtcgggggcggcgaccccagggccgcaggccgggggctcagggcgcgcactaggggccgaggtacagagccccagccgccttccctcccgcactcccccgggcccgggcctcccgcgcccaccccgcggtcgcccctgccctcagcgcagtcaggccagcggcctcggcggacccgacgctctgcgcccggcgcgcgcccgcggcaggagcggggacggggacggggacggggacggacggggacgcggacgggggaggaggccgcggcaggggcgggcgcggtacctgcgggtcgatgtcgcccaccgcgtaatacttgacctccctgaacatctcctcaggaactttgggcgcctggtccgacatgatcgcggcggcccgggaggctccgcggcggcgcccggccccg

SEQ ID NO: 1111 - DNA, 20971 bp, Homo sapiens
ccttaaagccctaaatggcggcttcaatatcagtcccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggaggtgagaacacaagtgatgggagagcctggggagggactgtctggtgagtaaaggttgtgctgctctgtggatgaaatgtctctgaggtcgtaaacatctcagagccgccttcgggagaacgggtgatagtcatctgggctgatgtcacctccagtgtcctctcctgtgatctgtgttaatcctcccagattgacgagattcctggggaggcgattcatgacagctgagttccttttggaggatccgtcttcaggcaggtaaggggagctcagaggaaacctctgcctgcatccgctgattcccaagtgccctcagctcacagggatcagcactcccaagtgccatgggggtggcatttcctgaactccttcaaagcaataacaacaggctgggcgtggtggcttacgcctgtaatcccagcactttaggaggctgaagtgtgaggattgcttgaagccaggagttcaagaccagcctgggcaacatagggaaaccctgtctctacaaagaattaaaagaaaacttagccaggaatggcagtgcacacatgtggccccgcctactcgggagactgaggtgggaggagtgcttgagccaggtggttgaggctgcagggagctgtgattgcaccactgcactccagcctgggcaacagagtgagactctatctcaaaacaaacaaacaacaacaacaaaagtgaaacaataacaacaacttttacaaaacggacatttgggatctacatgccacactcctaaatgcgtctcttaagcaacaggtgtcacagtcttaaaccttgtccttaccctcttcattctaggcacctgtttcattccaggtagggcttcctcctggtttcctaacacagcgggttgagatgaacagcagagaaggacactgcacacctctgcagggtctcccctctggcccaccagccctcccttctccagcagtgaagacctcactatgtcatccaggcaggaataatatagacagaaaccccagaagccccaaagctctgaagcctaaaccacaagccccacgaagttccacagggcccactgggcagaatggcgtgaaccttcagggtttgtttggttttatgaaccatttagtcattctttctccttcctcccatggtagcactaaaatacattctcaggctcccaggtatatacaggggggacggagaggcgaggatattcctgattggaaaacaaaacaaaacctacctttactaatctcaatatacagattaggctaatcagattaaataattctgaaagttttcaaaatgtcattgttagatttttcattattttagagaagaggtcttactctgttgcccaagctggactcaaactcctgggctcaagcgaacctcctgcctcagcctcctgagtagctggactacaggtgcgcaccaccatgcctggctgaaattggtttttattgagggtcttgatatgaaaaaaaagtctttgaatcttaatgttactttttcatttcttcttggcaaccaaagcatccatgttttaatttttctttgtttattgttggctggagagcactgccttcctcatgtaccatgcatcaagccctctccccagcctgaagaacaccatgttcctcttagcgatcatcagtaacaaggcgtgccactcgaagaactacaaagataagggtttggggtttgtgctggggaaagctcatgacactagctgcaggaatagaggactgagcctcccaagtcctggaaagcagagggaggatgccccgctctgatttcctcagcacctttgcagagctcttggtctcctgcctgtgccctgcaggcctgactcaccttcctctctgcacgtgagactctgcacacctcctatcgtgtttattgacgcatggcagcctcagccctccatttcatgtgacctcccagctttgctctctacaacacctaacccagtcagtttctgtgtcctaattcaaaattgctgggagaaaaaaaagtctgattggcatttgagtttgagaacgaaggcttgaaagagccagtttgaagaatgggagcaaggcctggctagagcactgatcgacaaacttttcctgtaaagggctgggtagtagatattgcaggctttgcaggccatgaaatccacgctgcattgtagtggcatgcaagctgccatagccaatctgtaaatgaatgagtgtggctgggtcgcattagcattttatttccaaaaatagcaggtggccagatttggcccagggactataattttccaattcctgagatactagaaacagaagtgttttgttgttgttttaactaactctttattgaagtacagcaaacaaaagtatacacattatagcattgtatgaactatcacagagtgactacacgcatgtaaccaccaactgtgtgaagaaaacattgcctgcatcccagaaactatgtatgcacccttactagtcactaatctcacactcctccccaaaagtaactaaaactctgatttgtattgtcagtggtttctcctgttttggactttatataaatgaagtcatattgtatgtatttctactttctgtctaacttctttgtatgatattctcccagtggaattcatctgtattgtggtttgtaccaatggttcatttctttttattgttattataatattttattgcattactataatagtatttatttcattctactgtagatggacatttaacattgtttctagtttggggctgctgcatgtctttggatgaatatgtgtacacatttttgttggaaatagaattgctggtccaacatagatagatagataggtaggtagatacatagatagatagatagatttattattgaatatatataacaaaatgttcttattgttcatcataatttccaaatgacattttttttctatttggtgtggaataactttcatatcttccattaatttttttagacatagttcttttatttgaacatgtttttgatacctggtttaatgtctttgtctaataagtccaacatctgggcttactctgggacaatttcttttgactacttttttatgtttataggccatacttgcctgttcttttgtgtgtctcctaattatttggttgaaaactagacactttaaataatatatcgactctggaaattagagttgttgctgtttttgtgattgctgttgtggtggtggtttatttgtttagtgatgtttctggattggtattgtaaagtctgtattcttttttgtgtgcagccactaaagtatttacttggttagcttagtggtcagctaatgattggacagagaattccttaaatgccttcaaccaataagcctccccttgctcatgggctgtttgttagggtatgtcttcaatgtccctgcaattcacaactccaccttagtcttcactcctgcttgatcagaccctcaagagccactggagtaagtacttagggccttcctggtctctcttgggcctgcatgcagccgtgcacacaggaggccttctaatcccccaggaataagttggagcttttcaaagcccctaagaatatctctgtccctagactttccttgtaagttttatatccaatttcttttttctttcttttttttttttttttttgagacggtgtctcgctctgtcacccaggctggagtgcagtggcacgatcttggctcactgtaagctccacctcctgggttcacgccattctcctgcctcagcctcccgagtagctgggaccacatgtgcccaccaccacgcctggctaattttttgtatttttagtagagacagggtttcaccattttagccaggatggtctcgaactcctgaccttgtgatcctcccgccttggcctcccaaagtgctgggattacaggtgtgagccaccatgcccggccttttatatccaatttcttatctgccctaagtggcaccaccacttttgacagctgggatgttgaacagttagtgctgattgattttcacaaacaccctggggatggggctttcctcactgggagatctgaatcaggtcaaataaaggtgagccttgtgaatggggcttgaataggagctgccagcccaggagaaagattgatgattctctgggaatgaggtttttggggctctgaagctgtcctgcccctctagtccgtccattaggctgttggttttcactactaccacagttccaaggctgctgtttttcaaggctgctgcagagctgatggtggttgagggggtgggactggggaagaggcaaagttaaaattccacaaagcctgctgtttactgagtttcagccattttctttaactaacactctgaattgttccaatcctattgttaatatccagagttctgaaaaagtggattttgacagcttatgctacgtcccttctcttacggaggcacagattcttggagggccctccaccatcagttcacacatccttctccaggcattatggctggtggtttttattttttaccatggtaaattttaaatcttttctaggccaaatttttttttagtatgataaaagacacagaaaaaaaagcatacacacacacacagtaacacacatacacagaggtacattggcctattatttaattctatatgtggatgttgggttttgtgttagtctgttctcatgctgttgtaaagaactgccaaagactgggtaatttataaatgaaagaggtttaattgactgacagttcaacagggcttgggaggcctcaggaaacttacaatcatggtggaaggtgaagcaaatatgtccttcttcacatggcagcaggaaggggaagcatcgagcaaagagggaacagccccttataaaaccatcacatctcatgagaactcactcaatattatgagaacagcatgggggtaactgctcccatgattcaattacttccaactgggtccctcccccaacatgtggggattacaattcaagatgagatttgggtggggacacagacccagaccatattatacacactggcccctctcaaatcttgtctttctcacatttcaaaacacaattatgtcttcccagtgatttcccaaactcttcagtcatttcagcgttaaccccaaagcccaagtccatagtatcttctgagacaaggcaagtcccttccacctatgagcctgtaaaatcaaaagcaagttagttacgtcctagataaatgcgggtacaagcattgggtaaatacgcctgttccaaatggaagaaattggccaaaatgaaggggctacaggccccatgcaactctgaaatcaaatagggcagtcatcaaaccttaatgcaccaaaatgatctcttttgactccaggtcttacatacaggtcacgctgatgcaagaggtaggctcccacagccttgggcagctctgcccctgtggttttgcagggtacagccccccaccccccgccagctgctttcacggcaggctttgagtgtctttggcttttccaggtgcatggtgcaagctatcagtggatctaccattctggggtctggaggatggtgaccctcttctcacagctccactaggcaatgcctcagtggggatgctgtgtgggggctctgaccccacatttcccttcagcactgccctagcagaggttctccatgagggctccacccctgcagcagacttctgcctggacatccaggcgtttccatacatactctgaaatctaggtgaaggtccccaaacctcaattcttgtctaatgcacacctgagggactaacaccatgtggaagctgccaaagcttggggcttcaccctctgaagcaattgcctgagcatgtatcttggccccttttagccgcagctagagctgaagcagctgggatgcattgcaactagtcctcaggatgcgcacagcaggggggccctggacctggcccatgaaaccatttttgcctcctagacctccaggcctgtgataggaggggctgctgcaaaggtctctgacatcccccagagacattttccccattgtcttggtgattaacatttggctcctcgttacttatgcaaatttctgcaactggcttaaatttctccccagaaaatgagtttttcttttctaccgcattgtcaagctgcaaatttcccaaactttatgctctgtcacctcttgaatgctttgctttagaagtcaaaattctaaaacagaattctaaagaaatttctaaagttcagaaatttcttccatcagataccctaaatcatccctctctagttcagatatctagggcaggggcaaaatgccaccagtctctttggtaaactatagcaagagtcaacttcattctagttcccaacaagttcttcacctccatctgacaccacctcagcctggacttcattgtccacctcactatcagcattttggtcaaaaccattcaataagtctctaggaagtttcaaactttcgcatatctccttgtcgtctgaaccctccaagtatctaggaagttccaaactttcccacattttcctgtcttcttctgagccctccaaactgtttcaatctctgtctattaccagttccaaagttgtttccacattttttgagtatccttatagcagcaccttactctgtggtaccaatttactgtattagcctattcttacactgctataatgaactgctggagactgggtaatttataaaggaaaaggtttgacttatacttccacagggctggggaggcctcgagaaacttacaatcatggcagaagttgaagcaaacacgtccatcttcacatggtgcccaaaaggagaagtgttgagcaaaggggaaaaagccccttataaaaccatcagatctcatgcgaacacactcactatcatgagaatagcatgggggtaactgctcccatgatttatttacctcccaccaagtccctgccccaacacgtggggattacatttcaggttacaattcaagataagattcgggtggggacacaaagacagaccatatcaggttttgaacacaaggtttaagagaagtttaaagaaagtcctgtggaagagctaaatatgaattcccaacagaatctccccttggccaacctccttgtcatcagttcactggctaaactagtgctctgcatttccttgtttttaaattgtgatgaaatatacacaatacagaacttaacacgttaaccatttttaagtgtacaggtttgttacttttaagtgcattcacattgttgtgcagtcatcaccacctcatctccattacttttttcatcttaaaactgaaactctatgcccattacataactctccacgcttctcccagcccctggaaaccaccattctactttctgtgtctttatatttgactactctaggaacctcatgcaagtggaatcatacattatctgccttttgtgactgatttctttcacttagcattatattttgaagtgtaggataaatcatacactatgtgtcttttgtaactgatttctttcacttagcaatatatttcaaaggttcatccatgttgtagtgtgtgttagaattttcttcctttttaaggctgagtgatatttttaaggctgaatgatatgcccttgtatgaatagaacacatttgtttattcattcatctaatgatgaacacctggtttgcttccaccttttgtctattgtgaatgctgctactataaacatgggcttacaaatatcttgaggagcccctgctttcaattgttttgggtatatacccagaagtgggattgctaaatcatatgttgatactatttttaattttttgagggcatgctatactgttttccattttacattcccaacagcagtgcacacatgtccaatttctccaaatcctcacctacatgtgttatttcctgcttttttttgacagtagttattctaatgagtgtggagttgttagggtccagcctcaacgccacccacgggtacccaaagtttggtggcggcaaaggaatgagaagagacaagttaagagtgaaaggtggggagctgggggccagtgcaaaatgtggaggctgcaaaaggctcagagctctggtttccacactatttattgagtacaatcacttagatctgagaagcaggggttcaggggtgaaatggggaaaggcagacagtgcgttatacgtgtaatgtatagcagtggcggtttaagtgaatctcctttgtgctcaaatagtatatctttagttacttgttgggaccgggcttaactaggagcctgcatatctagccacattctaatgcttcataggagtgtctttctccttgaacacagtgtttatggataagagagcaagtcttgctcagagcatgggaacatagtggctataagaaggctttcttcttcagaggcctcttgtggctttccgcaacttattgtctcatatttttatggccagtttatgcaggcaccccataagcctttctcccaacatggagtggtattttattgtgactttaattcacatttctctaatgattggtgacactgagctttcttttttttcatgtgcttattgtccatttatatgccttctttggagaaatgtctatttcaagtctcttacccattttttaattaagttgattcttagctgttgagtcataggagttccttatatattccagatattaatcctttatcagatatatgatttgcaaacattctttcccatctgatgggttgccttttcactctgttgtcttttaatatataaacattttacattttggtgtagcccaatttatattttcttttgttgtctatgcatttggtgttgtatccaagaagtcactgccaaatccaatatcatgaagcttttctatgttgtcttctaagagttttatagttttagttcttagctttaggactttgattcattttgagttcatttttgcacatggtgaaaggtaatgttccagcaacatccttttgcatgtgggtatccagttttttccagtagcatttgttagaatgactgtcctttctcccattgaaaatcttagcacccttgccaaaaatcatttggccctatgtgcaaaggtttatttcaggactctctattttatttcagtggtcaataagtctttatgccaacatcatgctgtcttgattgctgtcactttataatattttgaaatcaggaagtgagacttccaactttgttctcctttttcaagattatttttgctgttcactcttaagattccatgtgaattttatggtcaagttttctatttctggaaaaaacgtcattgagattttgatagggattgcattgaaaccatagattgctttggttggtattgacatcttaacaatatcaagtcttccaatccatgaacatgggatgtctttccatttattggtatcttctttaatttcttttatcaatattttgtagttttcagcatacacatctttcacctccttggttaagtttattcccaagtattttattctttttaatgctattgtaaatggaattgttttaattaccttttcagactgttcattgttagtatataaaaacacaactgattttcgtgttgactttgtattttctggtttattagttctgtcaggttggtgtttttgtttgttctggtggtatctttagggtttctacatacctttagggtttgctacatataagatcatgtcacctgtgaactaccccattaagctttatattttaattatattttatttctacatgttccttttgatactttttcaaatctgctgggtcattcttcatagtttcttatttcctgctaatattttaagcctgcctcaggagatattaactctgttgtgttctctcataattccaaattatgtggctctatttcctatttctgtgtctggtgtgtgcccatttttgttcatgatgccttgcttccttgctattttctctgtgggataagtatgtgtttagtccaagatggggaggggggtatctccaaggaggatttgtaattccttatgcaattgctttagggtgctactagcctaaattctgaggttgaagggtttttggaccatccacgtattgtgaattagtgcagcagccctaaggttcaagactggcagtgactcccagggttgttgggggcagatttatgtttatttctatttcatatttatacctagggcatagccctttggggttccagtcttagggaaggaggatcttctatttcactcctcactttgggcaggtcctgaacacttaccttctccacagtgaggctgtgaaactcaagttcagctgcttggacaaatgctctcaaggcaatggcctcagtgcttagctagtccctgagttttcatctttacttagttcttggcctgagtactcctgttttgccagctcatgggtttattttctatatctaaggtcaccatttttcattatcagaaggataactagtcaaggtagctgcccaccatattgccagagatacaaatgtctccctgaacacttgaggtctcataccatcaaaattctcatctcaccttgtcaaccattcctttgatatcttccactgaccactgagaattggtcttcaagccccagtccttggcagtacaaagggtaattagggagtgttgacctacaattacctaatgccactatgataactccccagtaacggaactcagcttacatgcttacccaaattgcagccttaatttcactataaaattttctctggctgccttaccaagttcattgtttatatcattatcactaatttcttttctccaaatgtaaaatttttagtttaaatcatgaacaaagcgatgttgttttcctttgaaacaccccctttttctctaagtctatcctaattccaggtcttactacttcttatagaggtgaatccaacatgttttgttcacttacctgccttcactgtgtctactttcaaattaatctttctggaatagtttttattatatcccctccccccacaaaaaattaaaactattccttattttccctctgataattttagttcaacacattttgagcaaatgcctataaaatgccaagcaatctacaaaaatttgggatactgtcagttttctattgctgctgtaacaaattgccacaaatttagtggcttaaatgagaacaactaaaaactattgttttacagttctataggtcagaagtctggtggagtctcattggagtaaaatcactcttagttccttgcatctgtaggactaaggtcccattttccaaaccactttcctgtcttcctcttccactgtgaggggttcacgtgattcactcgggccttcctggataattctgccttcctcttccactgtgaggggttcacatggctcgcttgggccttcctggataatgcaggctcatcgccccatctcaaggtcctcaaccttaatcacacctgcaaagtatcttttgccactaagctaacatagaagccacaggttctggggattaggtctaggacagggattccccagcccccaggtcacgtaccagtacgagtccacggcctattaggaactgggctgcacagcagctgagaggtgggcgagtgagcattaccgcctgagctctgcctcgtatcagatgactggcagcattagattctcatgggagcacgaactctattgtgaactgcacatgccaagcatctgggttgcgtacttcttatgagaatctaatgcctgaagatctgaggttgaacagtttcatcctgaaacataccctaaacccctacccaatctatgggaaaattatcttccatgaaaccactccctggtgccaaaaaggtaaggggctgctggtctagggtatctttggggggctataattccacctaccacagataacataggtgaagaaggcctcaatctgtctctgaggcttcattaacgcagagagaaacagagtgcgaacaagtaaccactcacctctaagacatctattccattgtatcagagagggctgaggacacaaagaggaggaaactagaaagaatgtttataaagatcaggaaggccttacagtctaaatgaggggaaagcttgccagataggaatgggagttcttctaataggaagagatagcatataaagtgagagaggcctgtgaagtgtttggcaagcttgggtaatcacaactgattccatgtgactaatgggagtaagggggtgggatggtgacattacaagagattaagatgctggccgtggtggcacgcacctgtagtcccagctgtttggaaggctgaggcacgagaatcgcttgggcccgggaggtggaagttgcagtgagccaagatcatgccactgcactccagctagcactagagtgagactcgatctcaaaaaaaaaaaaaaaaagaaaaagatgtgaaacatctcatcttggactctttctttttagcattaatatgagaaacagaatcttatttcaggaaaattactcctggaacagtacagaggtcaacctgaaaggaaagcgactggagaaaaggagacaaatgtaaaaccttgctaacatttacaagaggaaaagaaatgaacacagtgagcgtggggagaggtagatatgaacagctctgcagttggaggaacaaaccttggaaataaggagaggtgacctgtgtttagctgcacccctagagggtggaatcggctgaggagcaagcccagcaacactgaagttcagagatggagcggctgggcggtgggcgagagaaactcttcggggacacatgtggttcatttcaggaggtagctaaactttctacaaagttagtacgtaattacacacttattttttaattcaacaaagtaatttgggagagcttcatggggagcagcactgaggtttaaagagctgaggatacaattatcttcatttaactttctatgctaaaatatttcttaaaaataaagttgtgcagctattactattcaaatatttccttaaattaccaaatatttgctagattgacatatgttgtttaacttttcctaatgagactaaactcctagagctaggatacgcagtatttcttccaagtttcctctcaatacctagcagatagattaaaaacacactttttgtgagctatcaggtagatacttttaattatcctacacaaagaaacaatcttgggatgatttggatggattatctatgtcttcatcattggcattcacattgcttgccattcttacttgccagtgttacagaattcagggtatactgaggtggcagctcggtgatggacagctgttcatcttctcaatgatcagccacccctggtcactgcacgctggaaaagtacctagtgcaagggaaggacctccattttttaattgcactttatgttaacttcaaaactggcattaattcagttattggaagacacttaactatcttttgaataatttgagtatataaacatacataatatcctttttcaactctaagtggtgtgaaatctaaacagatcaagtacttccaatgaaaatttcagaattgagatgttgtctaagtgtaaaatatacactggattttaaagacttggcatccctcaaacagtaaaaatatctcagtaatttctaaaaatattgattacttctggcagaagcaatatttggatgtattgtctacatattaaaactaattttaaaacatttattgtagctactaaaaatgtttaaattacacattgttcccattatatttctattagatgacaccgagccagatgaaaataggattaaatgagattttcatgtaagaaataatttgtccgatctaatcatttttttctaagaagtatttacttgaaatctttttatttttatatgttcatctaagtccctcttagtcaccaaatcaatgcttaacagctgtgcaagccagttggctttagacagctcctggagtttttaaggatcatttcttggcagctttagaaaaaaaagcactaattgaaaggttaatcaaatcagtcatatttgtatgttggttatataaacaccctgtctccaccaaagattaaacagacgcattatactctacccagaaggcccatttattctgtaatgattgtcacttgccttcaagcttctaagtagtagggaagtactttgaatactttgcaaatgaaaactctattctgatttatgaaatgcttccacactgccaggattctacagaatctaaaatattttatagcaacaccaattctacctgtggtacacaaggggaaaaggtcagttctacatctactcaaagataagtcagtatctaagtttatttaagcacaaaaatataagcttaaaaatagacatattttgaggcacaatgttggttaaaaaacagctctgaatgtctgcgacagcactggtcagcacgatctaaagatattagcagttactgccctgctcatctttaataaacaggcggtctcctaccattttatcacacctatgatccaacaagacgtgtactgcaacagggtctggaaagaagcaggatggatgcaagttccgtagcgtcactggttctcactggttgcgcctgtgcttagtgattgcaaaataatctgaatccacccctgcctgggatggagtttattacggtgacaaaaaaaatggctggcttctagaaattatttcttgaggtaaaaattgactggaaaatattttgtcttgaaattacttaaaatgtgatccggtttgatgcaaattataagttatgcaaaaaatgtggaataataaaggattactcaattctaagttcaaaagtacatttatttaaaatgtgggcaagatatcaatataaaagaaaacagagtataagaaataaaaataatcaaagtacaaaacatttcaaatctttaacatccataatttagagatagcaaggtctttatttacaccattttatttctagttgaagtcccgtaacagttttgtgaaaacatttaaaaacctggcaaatgaatcataaaacctaatgtgggctcttaaagtcatataatacaaaacataatttatgtttcctcagaataaaattgcacatcttaaaaagatgcagtatatttattatatctgtcttcctgcttcacagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtagtgacctctgcaattctaaaccgtccactttgggcaaaattcatcaagctatggatatgaaaaaaggcccccaaggtaatactcataagtctcctgtatgacttttaaagcaatttcttctgaaagtaaatgtagtgtagaacaggctttcacaaatacaaacatgaatgttaggaaaaagtctggaaaaaatgcaagagtacatgttgtataaaaaccaaatgcttatagcatatctgtaaaaatttaacaggcctcttatcattcctatcagtagctcctacaataattttctaatagatggcggtatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagctctttagcgttaagaggaaaatgtttgataaatgtaattaactggatgaatgtcagtgtatttaaatgtaaatatacttaaatgtaattacctggatgaaacaggcacacacgaagaaaaaaaaactcggcaaggatgggtatcattctgacctctgcgccttactgaagcagtcctatcccaaacacaaaattcccctgcttaaggaaaggtccactgaggttgacactggtcagaggtggcagaggctcccaccctcacagagaggaggagctccagcctcattgcaggaggcccagggagaagtcctgagaacagccctgagagaaggtgctctgcaatgggaaacggaagtggaaacagaattttcccataaggacctgtaaggcatgttttgcttcactgataggctgttcctacattaaaataataattcagagatttttaataaggaattcaaataacagatgatgagctttattttttcctgaatgtctgaaatagaaaaaagcctaggtgtcaatattctaaagactgacctttgcattttcctgacatgttgatgaagtattcattctgccgcttccatttagtagtaatttatctcccatcccaaagttcctgagtacaaagactatatacgaactaaatttcatttggaaaactacaaactcaaaggtgagctgataaaaagaaacatatatttatttttgcaattattttctattttatctaattgtcaaattctttaatacctccataaactagacagtatagatcctttctaattaacatcacctattaaaactgaactctcagtaagttaagagaatatttttactagcaactcaaatgaatattctgaagagaaaagaattgttcactgcataaatcacaatagcaaagaaaggaaaaatggcttgcaaaacaggaaaggtactgccttattaacctgggaaatccatttcatatctaacccgtctactttttaattctcttttggaaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggtgtgatgtaaaaatattttgcctaaaattaaatgaaaatatatgtattatgttcttaaaatgctttaatttttagagtacataattctcatagattctgccctgagatttttgacaaaatttcaaattttatgacattatgaaggtactattctcctactagcactcaatctgaagtggaagaggaatccagctatgtaaatttggaatgtaagcattttcacatgttaagtatgcctgaagatgatttaaagtaaccagaacttaagtccctaaaacaaagtgttttgtgaataagcaagaatattacaaatatttttcacaatttctatacaattttaaatcagcattatatttcaccacacttatctgcccagcaacagcctctggcatagcatgctgcctggcttatatcccttttctttattttctccatattatttgaactcagagcaggaaatgatattgatgcttaagatttaattatctaacaagattgctcctgaggataccacaaaatactattctgtctgaaactgcaaataatttctaattcctgttgactccttaagaaggttaaagaaccgattatctttattgatttacttagttctttggtacaaaaaaaattcctagctgttctaacacttatctaacatttaaaaatcttttagtactgaattatatctatgcacacactgaatattttcccaagtatcttctccagctgaatatacatttactgacaatagtacgaagtaagcgatgtcctctaaagatttattaaaagcagaaaaatgaacatgcctcttaaccaattactcaaaaacctattctttgaataacttatttctcatagatgtatttattaaatttgtgtacttatttttaaacattatagtaaagaaaagttctctagagatgtgctgtggttcacaggaggaagacctccagtggcaatgtccaagaaggaagccaagaggtaaatgggatgcagggtgagcccagctcccctggaggcgcacttcccaccaaatcacctggtagttcccttgagcaggtccgtgtgttatgcttacttggactgatttacttttcccttaaagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcaggtacataatattacagctacatttacctgtacagccttcggatatttaaatgtcaccattatatttcatttacttccctctaaaaacagccagaccaaaaagacagacaggtattttttctcctagatcagtggtaattaaccatttggggtcataaactcttgaaaaaaacgggctgggtgtggtggttcatgcctgtaattccagcactttgggaagccggggaaggaaagctgcttgatgccaggagttcgagaacagcctgggcaacacagtgagacttcatctctacagaaaaattttaaaatcagcttggcatggtggcatgtgcctgtagtcccagctactcgggggactgaagtgggaggatcgcttgagtctgggaagttcgaggctgtggtgagccatcattgcaccacagcaccccagcctgggcaacaaagtgagatctggtctcaaaataatagtaatttttttttttttaacaacaaaaatgtaaaaaaagaaaaaaaaaattactgaaaaatatgaaccctcttcccatagctgctcctcccctctttaccccccgactattttaggaagttcaccaactttccaagcccgcagatctcaggttaaaatctccagtcctagaaagacaagcttcaaataatcccatccaagtgtatattatatatatatatgttatatatatacactaactcctcaaggacttgtaggacattggagtcatttggctcataatcaattatgtgaattaccaaactttaaagatttaccaaacacacattcaagtatataaaagtatacagcaatttataaaggatagttttatcaatttttaaagacttctgacaattattaataattgacagattttcagttttcatagcaacattttaagaaatgtgtcaaaaggtaaagatcacaaaatgtttcaatcttcctataaatatgcctcatattcagaaaaccatttctcctccgccgccatttcctaccaaccatacagcataataaggcagctcaaacccaataatatatacatcaaaagcagaaaacaaggaaaagtgatttgggattggcaaactggggttgacaagatgatacatattttaggatttgtgggctatgtattatttctcctgcatattcctcttctcttttttaagcaatatttaaaaaatgtaaaaaccattttcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaa

SEQ ID NO: 1112 - DNA, 18335 bp, Homo sapiens
ccttaaagccctaaatggcggcttcaatatcagtcccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggaggtgagaacacaagtgatgggagagcctggggagggactgtctggtgagtaaaggttgtgctgctctgtggatgaaatgtctctgaggtcgtaaacatctcagagccgccttcgggagaacgggtgatagtcatctgggctgatgtcacctccagtgtcctctcctgtgatctgtgttaatcctcccagattgacgagattcctggggaggcgattcatgacagctgagttccttttggaggatccgtcttcaggcaggtaaggggagctcagaggaaacctctgcctgcatccgctgattcccaagtgccctcagctcacagggatcagcactcccaagtgccatgggggtggcatttcctgaactccttcaaagcaataacaacaggctgggcgtggtggcttacgcctgtaatcccagcactttaggaggctgaagtgtgaggattgcttgaagccaggagttcaagaccagcctgggcaacatagggaaaccctgtctctacaaagaattaaaagaaaacttagccaggaatggcagtgcacacatgtggccccgcctactcgggagactgaggtgggaggagtgcttgagccaggtggttgaggctgcagggagctgtgattgcaccactgcactccagcctgggcaacagagtgagactctatctcaaaacaaacaaacaacaacaacaaaagtgaaacaataacaacaacttttacaaaacggacatttgggatctacatgccacactcctaaatgcgtctcttaagcaacaggtgtcacagtcttaaaccttgtccttaccctcttcattctaggcacctgtttcattccaggtagggcttcctcctggtttcctaacacagcgggttgagatgaacagcagagaaggacactgcacacctctgcagggtctcccctctggcccaccagccctcccttctccagcagtgaagacctcactatgtcatccaggcaggaataatatagacagaaaccccagaagccccaaagctctgaagcctaaaccacaagccccacgaagttccacagggcccactgggcagaatggcgtgaaccttcagggtttgtttggttttatgaaccatttagtcattctttctccttcctcccatggtagcactaaaatacattctcaggctcccaggtatatacaggggggacggagaggcgaggatattcctgattggaaaacaaaacaaaacctacctttactaatctcaatatacagattaggctaatcagattaaataattctgaaagttttcaaaatgtcattgttagatttttcattattttagagaagaggtcttactctgttgcccaagctggactcaaactcctgggctcaagcgaacctcctgcctcagcctcctgagtagctggactacaggtgcgcaccaccatgcctggctgaaattggtttttattgagggtcttgatatgaaaaaaaagtctttgaatcttaatgttactttttcatttcttcttggcaaccaaagcatccatgttttaatttttctttgtttattgttggctggagagcactgccttcctcatgtaccatgcatcaagccctctccccagcctgaagaacaccatgttcctcttagcgatcatcagtaacaaggcgtgccactcgaagaactacaaagataagggtttggggtttgtgctggggaaagctcatgacactagctgcaggaatagaggactgagcctcccaagtcctggaaagcagagggaggatgccccgctctgatttcctcagcacctttgcagagctcttggtctcctgcctgtgccctgcaggcctgactcaccttcctctctgcacgtgagactctgcacacctcctatcgtgtttattgacgcatggcagcctcagccctccatttcatgtgacctcccagctttgctctctacaacacctaacccagtcagtttctgtgtcctaattcaaaattgctgggagaaaaaaaagtctgattggcatttgagtttgagaacgaaggcttgaaagagccagtttgaagaatgggagcaaggcctggctagagcactgatcgacaaacttttcctgtaaagggctgggtagtagatattgcaggctttgcaggccatgaaatccacgctgcattgtagtggcatgcaagctgccatagccaatctgtaaatgaatgagtgtggctgggtcgcattagcattttatttccaaaaatagcaggtggccagatttggcccagggactataattttccaattcctgagatactagaaacagaagtgttttgttgttgttttaactaactctttattgaagtacagcaaacaaaagtatacacattatagcattgtatgaactatcacagagtgactacacgcatgtaaccaccaactgtgtgaagaaaacattgcctgcatcccagaaactatgtatgcacccttactagtcactaatctcacactcctccccaaaagtaactaaaactctgatttgtattgtcagtggtttctcctgttttggactttatataaatgaagtcatattgtatgtatttctactttctgtctaacttctttgtatgatattctcccagtggaattcatctgtattgtggtttgtaccaatggttcatttctttttattgttattataatattttattgcattactataatagtatttatttcattctactgtagatggacatttaacattgtttctagtttggggctgctgcatgtctttggatgaatatgtgtacacatttttgttggaaatagaattgctggtccaacatagatagatagataggtaggtagatacatagatagatagatagatttattattgaatatatataacaaaatgttcttattgttcatcataatttccaaatgacattttttttctatttggtgtggaataactttcatatcttccattaatttttttagacatagttcttttatttgaacatgtttttgatacctggtttaatgtctttgtctaataagtccaacatctgggcttactctgggacaatttcttttgactacttttttatgtttataggccatacttgcctgttcttttgtgtgtctcctaattatttggttgaaaactagacactttaaataatatatcgactctggaaattagagttgttgctgtttttgtgattgctgttgtggtggtggtttatttgtttagtgatgtttctggattggtattgtaaagtctgtattcttttttgtgtgcagccactaaagtatttacttggttagcttagtggtcagctaatgattggacagagaattccttaaatgccttcaaccaataagcctccccttgctcatgggctgtttgttagggtatgtcttcaatgtccctgcaattcacaactccaccttagtcttcactcctgcttgatcagaccctcaagagccactggagtaagtacttagggccttcctggtctctcttgggcctgcatgcagccgtgcacacaggaggccttctaatcccccaggaataagttggagcttttcaaagcccctaagaatatctctgtccctagactttccttgtaagttttatatccaatttcttttttctttcttttttttttttttttttgagacggtgtctcgctctgtcacccaggctggagtgcagtggcacgatcttggctcactgtaagctccacctcctgggttcacgccattctcctgcctcagcctcccgagtagctgggaccacatgtgcccaccaccacgcctggctaattttttgtatttttagtagagacagggtttcaccattttagccaggatggtctcgaactcctgaccttgtgatcctcccgccttggcctcccaaagtgctgggattacaggtgtgagccaccatgcccggccttttatatccaatttcttatctgccctaagtggcaccaccacttttgacagctgggatgttgaacagttagtgctgattgattttcacaaacaccctggggatggggctttcctcactgggagatctgaatcaggtcaaataaaggtgagccttgtgaatggggcttgaataggagctgccagcccaggagaaagattgatgattctctgggaatgaggtttttggggctctgaagctgtcctgcccctctagtccgtccattaggctgttggttttcactactaccacagttccaaggctgctgtttttcaaggctgctgcagagctgatggtggttgagggggtgggactggggaagaggcaaagttaaaattccacaaagcctgctgtttactgagtttcagccattttctttaactaacactctgaattgttccaatcctattgttaatatccagagttctgaaaaagtggattttgacagcttatgctacgtcccttctcttacggaggcacagattcttggagggccctccaccatcagttcacacatccttctccaggcattatggctggtggtttttattttttaccatggtaaattttaaatcttttctaggccaaatttttttttagtatgataaaagacacagaaaaaaaagcatacacacacacacagtaacacacatacacagaggtacattggcctattatttaattctatatgtggatgttgggttttgtgttagtctgttctcatgctgttgtaaagaactgccaaagactgggtaatttataaatgaaagaggtttaattgactgacagttcaacagggcttgggaggcctcaggaaacttacaatcatggtggaaggtgaagcaaatatgtccttcttcacatggcagcaggaaggggaagcatcgagcaaagagggaacagccccttataaaaccatcacatctcatgagaactcactcaatattatgagaacagcatgggggtaactgctcccatgattcaattacttccaactgggtccctcccccaacatgtggggattacaattcaagatgagatttgggtggggacacagacccagaccatattatacacactggcccctctcaaatcttgtctttctcacatttcaaaacacaattatgtcttcccagtgatttcccaaactcttcagtcatttcagcgttaaccccaaagcccaagtccatagtatcttctgagacaaggcaagtcccttccacctatgagcctgtaaaatcaaaagcaagttagttacgtcctagataaatgcgggtacaagcattgggtaaatacgcctgttccaaatggaagaaattggccaaaatgaaggggctacaggccccatgcaactctgaaatcaaatagggcagtcatcaaaccttaatgcaccaaaatgatctcttttgactccaggtcttacatacaggtcacgctgatgcaagaggtaggctcccacagccttgggcagctctgcccctgtggttttgcagggtacagccccccaccccccgccagctgctttcacggcaggctttgagtgtctttggcttttccaggtgcatggtgcaagctatcagtggatctaccattctggggtctggaggatggtgaccctcttctcacagctccactaggcaatgcctcagtggggatgctgtgtgggggctctgaccccacatttcccttcagcactgccctagcagaggttctccatgagggctccacccctgcagcagacttctgcctggacatccaggcgtttccatacatactctgaaatctaggtgaaggtccccaaacctcaattcttgtctaatgcacacctgagggactaacaccatgtggaagctgccaaagcttggggcttcaccctctgaagcaattgcctgagcatgtatcttggccccttttagccgcagctagagctgaagcagctgggatgcattgcaactagtcctcaggatgcgcacagcaggggggccctggacctggcccatgaaaccatttttgcctcctagacctccaggcctgtgataggaggggctgctgcaaaggtctctgacatcccccagagacattttccccattgtcttggtgattaacatttggctcctcgttacttatgcaaatttctgcaactggcttaaatttctccccagaaaatgagtttttcttttctaccgcattgtcaagctgcaaatttcccaaactttatgctctgtcacctcttgaatgctttgctttagaagtcaaaattctaaaacagaattctaaagaaatttctaaagttcagaaatttcttccatcagataccctaaatcatccctctctagttcagatatctagggcaggggcaaaatgccaccagtctctttggtaaactatagcaagagtcaacttcattctagttcccaacaagttcttcacctccatctgacaccacctcagcctggacttcattgtccacctcactatcagcattttggtcaaaaccattcaataagtctctaggaagtttcaaactttcgcatatctccttgtcgtctgaaccctccaagtatctaggaagttccaaactttcccacattttcctgtcttcttctgagccctccaaactgtttcaatctctgtctattaccagttccaaagttgtttccacattttttgagtatccttatagcagcaccttactctgtggtaccaatttactgtattagcctattcttacactgctataatgaactgctggagactgggtaatttataaaggaaaaggtttgacttatacttccacagggctggggaggcctcgagaaacttacaatcatggcagaagttgaagcaaacacgtccatcttcacatggtgcccaaaaggagaagtgttgagcaaaggggaaaaagccccttataaaaccatcagatctcatgcgaacacactcactatcatgagaatagcatgggggtaactgctcccatgatttatttacctcccaccaagtccctgccccaacacgtggggattacatttcaggttacaattcaagataagattcgggtggggacacaaagacagaccatatcaggttttgaacacaaggtttaagagaagtttaaagaaagtcctgtggaagagctaaatatgaattcccaacagaatctccccttggccaacctccttgtcatcagttcactggctaaactagtgctctgcatttccttgtttttaaattgtgatgaaatatacacaatacagaacttaacacgttaaccatttttaagtgtacaggtttgttacttttaagtgcattcacattgttgtgcagtcatcaccacctcatctccattacttttttcatcttaaaactgaaactctatgcccattacataactctccacgcttctcccagcccctggaaaccaccattctactttctgtgtctttatatttgactactctaggaacctcatgcaagtggaatcatacattatctgccttttgtgactgatttctttcacttagcattatattttgaagtgtaggataaatcatacactatgtgtcttttgtaactgatttctttcacttagcaatatatttcaaaggttcatccatgttgtagtgtgtgttagaattttcttcctttttaaggctgagtgatatttttaaggctgaatgatatgcccttgtatgaatagaacacatttgtttattcattcatctaatgatgaacacctggtttgcttccaccttttgtctattgtgaatgctgctactataaacatgggcttacaaatatcttgaggagcccctgctttcaattgttttgggtatatacccagaagtgggattgctaaatcatatgttgatactatttttaattttttgagggcatgctatactgttttccattttacattcccaacagcagtgcacacatgtccaatttctccaaatcctcacctacatgtgttatttcctgcttttttttgacagtagttattctaatgagtgtggagttgttagggtccagcctcaacgccacccacgggtacccaaagtttggtggcggcaaaggaatgagaagagacaagttaagagtgaaaggtggggagctgggggccagtgcaaaatgtggaggctgcaaaaggctcagagctctggtttccacactatttattgagtacaatcacttagatctgagaagcaggggttcaggggtgaaatggggaaaggcagacagtgcgttatacgtgtaatgtatagcagtggcggtttaagtgaatctcctttgtgctcaaatagtatatctttagttacttgttgggaccgggcttaactaggagcctgcatatctagccacattctaatgcttcataggagtgtctttctccttgaacacagtgtttatggataagagagcaagtcttgctcagagcatgggaacatagtggctataagaaggctttcttcttcagaggcctcttgtggctttccgcaacttattgtctcatatttttatggccagtttatgcaggcaccccataagcctttctcccaacatggagtggtattttattgtgactttaattcacatttctctaatgattggtgacactgagctttcttttttttcatgtgcttattgtccatttatatgccttctttggagaaatgtctatttcaagtctcttacccattttttaattaagttgattcttagctgttgagtcataggagttccttatatattccagatattaatcctttatcagatatatgatttgcaaacattctttcccatctgatgggttgccttttcactctgttgtcttttaatatataaacattttacattttggtgtagcccaatttatattttcttttgttgtctatgcatttggtgttgtatccaagaagtcactgccaaatccaatatcatgaagcttttctatgttgtcttctaagagttttatagttttagttcttagctttaggactttgattcattttgagttcatttttgcacatggtgaaaggtaatgttccagcaacatccttttgcatgtgggtatccagttttttccagtagcatttgttagaatgactgtcctttctcccattgaaaatcttagcacccttgccaaaaatcatttggccctatgtgcaaaggtttatttcaggactctctattttatttcagtggtcaataagtctttatgccaacatcatgctgtcttgattgctgtcactttataatattttgaaatcaggaagtgagacttccaactttgttctcctttttcaagattatttttgctgttcactcttaagattccatgtgaattttatggtcaagttttctatttctggaaaaaacgtcattgagattttgatagggattgcattgaaaccatagattgctttggttggtattgacatcttaacaatatcaagtcttccaatccatgaacatgggatgtctttccatttattggtatcttctttaatttcttttatcaatattttgtagttttcagcatacacatctttcacctccttggttaagtttattcccaagtattttattctttttaatgctattgtaaatggaattgttttaattaccttttcagactgttcattgttagtatataaaaacacaactgattttcgtgttgactttgtattttctggtttattagttctgtcaggttggtgtttttgtttgttctggtggtatctttagggtttctacatacctttagggtttgctacatataagatcatgtcacctgtgaactaccccattaagctttatattttaattatattttatttctacatgttccttttgatactttttcaaatctgctgggtcattcttcatagtttcttatttcctgctaatattttaagcctgcctcaggagatattaactctgttgtgttctctcataattccaaattatgtggctctatttcctatttctgtgtctggtgtgtgcccatttttgttcatgatgccttgcttccttgctattttctctgtgggataagtatgtgtttagtccaagatggggaggggggtatctccaaggaggatttgtaattccttatgcaattgctttagggtgctactagcctaaattctgaggttgaagggtttttggaccatccacgtattgtgaattagtgcagcagccctaaggttcaagactggcagtgactcccagggttgttgggggcagatttatgtttatttctatttcatatttatacctagggcatagccctttggggttccagtcttagggaaggaggatcttctatttcactcctcactttgggcaggtcctgaacacttaccttctccacagtgaggctgtgaaactcaagttcagctgcttggacaaatgctctcaaggcaatggcctcagtgcttagctagtccctgagttttcatctttacttagttcttggcctgagtactcctgttttgccagctcatgggtttattttctatatctaaggtcaccatttttcattatcagaaggataactagtcaaggtagctgcccaccatattgccagagatacaaatgtctccctgaacacttgaggtctcataccatcaaaattctcatctcaccttgtcaaccattcctttgatatcttccactgaccactgagaattggtcttcaagccccagtccttggcagtacaaagggtaattagggagtgttgacctacaattacctaatgccactatgataactccccagtaacggaactcagcttacatgcttacccaaattgcagccttaatttcactataaaattttctctggctgccttaccaagttcattgtttatatcattatcactaatttcttttctccaaatgtaaaatttttagtttaaatcatgaacaaagcgatgttgttttcctttgaaacaccccctttttctctaagtctatcctaattccaggtcttactacttcttatagaggtgaatccaacatgttttgttcacttacctgccttcactgtgtctactttcaaattaatctttctggaatagtttttattatatcccctccccccacaaaaaattaaaactattccttattttccctctgataattttagttcaacacattttgagcaaatgcctataaaatgccaagcaatctacaaaaatttgggatactgtcagttttctattgctgctgtaacaaattgccacaaatttagtggcttaaatgagaacaactaaaaactattgttttacagttctataggtcagaagtctggtggagtctcattggagtaaaatcactcttagttccttgcatctgtaggactaaggtcccattttccaaaccactttcctgtcttcctcttccactgtgaggggttcacgtgattcactcgggccttcctggataattctgccttcctcttccactgtgaggggttcacatggctcgcttgggccttcctggataatgcaggctcatcgccccatctcaaggtcctcaaccttaatcacacctgcaaagtatcttttgccactaagctaacatagaagccacaggttctggggattaggtctaggacagggattccccagcccccaggtcacgtaccagtacgagtccacggcctattaggaactgggctgcacagcagctgagaggtgggcgagtgagcattaccgcctgagctctgcctcgtatcagatgactggcagcattagattctcatgggagcacgaactctattgtgaactgcacatgccaagcatctgggttgcgtacttcttatgagaatctaatgcctgaagatctgaggttgaacagtttcatcctgaaacataccctaaacccctacccaatctatgggaaaattatcttccatgaaaccactccctggtgccaaaaaggtaaggggctgctggtctagggtatctttggggggctataattccacctaccacagataacataggtgaagaaggcctcaatctgtctctgaggcttcattaacgcagagagaaacagagtgcgaacaagtaaccactcacctctaagacatctattccattgtatcagagagggctgaggacacaaagaggaggaaactagaaagaatgtttataaagatcaggaaggccttacagtctaaatgaggggaaagcttgccagataggaatgggagttcttctaataggaagagatagcatataaagtgagagaggcctgtgaagtgtttggcaagcttgggtaatcacaactgattccatgtgactaatgggagtaagggggtgggatggtgacattacaagagattaagatgctggccgtggtggcacgcacctgtagtcccagctgtttggaaggctgaggcacgagaatcgcttgggcccgggaggtggaagttgcagtgagccaagatcatgccactgcactccagctagcactagagtgagactcgatctcaaaaaaaaaaaaaaaaagaaaaagatgtgaaacatctcatcttggactctttctttttagcattaatatgagaaacagaatcttatttcaggaaaattactcctggaacagtacagaggtcaacctgaaaggaaagcgactggagaaaaggagacaaatgtaaaaccttgctaacatttacaagaggaaaagaaatgaacacagtgagcgtggggagaggtagatatgaacagctctgcagttggaggaacaaaccttggaaataaggagaggtgacctgtgtttagctgcacccctagagggtggaatcggctgaggagcaagcccagcaacactgaagttcagagatggagcggctgggcggtgggcgagagaaactcttcggggacacatgtggttcatttcaggaggtagctaaactttctacaaagttagtacgtaattacacacttattttttaattcaacaaagtaatttgggagagcttcatggggagcagcactgaggtttaaagagctgaggatacaattatcttcatttaactttctatgctaaaatatttcttaaaaataaagttgtgcagctattactattcaaatatttccttaaattaccaaatatttgctagattgacatatgttgtttaacttttcctaatgagactaaactcctagagctaggatacgcagtatttcttccaagtttcctctcaatacctagcagatagattaaaaacacactttttgtgagctatcaggtagatacttttaattatcctacacaaagaaacaatcttgggatgatttggatggattatctatgtcttcatcattggcattcacattgcttgccattcttacttgccagtgttacagaattcagggtatactgaggtggcagctcggtgatggacagctgttcatcttctcaatgatcagccacccctggtcactgcacgctggaaaagtacctagtgcaagggaaggacctccattttttaattgcactttatgttaacttcaaaactggcattaattcagttattggaagacacttaactatcttttgaataatttgagtatataaacatacataatatcctttttcaactctaagtggtgtgaaatctaaacagatcaagtacttccaatgaaaatttcagaattgagatgttgtctaagtgtaaaatatacactggattttaaagacttggcatccctcaaacagtaaaaatatctcagtaatttctaaaaatattgattacttctggcagaagcaatatttggatgtattgtctacatattaaaactaattttaaaacatttattgtagctactaaaaatgtttaaattacacattgttcccattatatttctattagatgacaccgagccagatgaaaataggattaaatgagattttcatgtaagaaataatttgtccgatctaatcatttttttctaagaagtatttacttgaaatctttttatttttatatgttcatctaagtccctcttagtcaccaaatcaatgcttaacagctgtgcaagccagttggctttagacagctcctggagtttttaaggatcatttcttggcagctttagaaaaaaaagcactaattgaaaggttaatcaaatcagtcatatttgtatgttggttatataaacaccctgtctccaccaaagattaaacagacgcattatactctacccagaaggcccatttattctgtaatgattgtcacttgccttcaagcttctaagtagtagggaagtactttgaatactttgcaaatgaaaactctattctgatttatgaaatgcttccacactgccaggattctacagaatctaaaatattttatagcaacaccaattctacctgtggtacacaaggggaaaaggtcagttctacatctactcaaagataagtcagtatctaagtttatttaagcacaaaaatataagcttaaaaatagacatattttgaggcacaatgttggttaaaaaacagctctgaatgtctgcgacagcactggtcagcacgatctaaagatattagcagttactgccctgctcatctttaataaacaggcggtctcctaccattttatcacacctatgatccaacaagacgtgtactgcaacagggtctggaaagaagcaggatggatgcaagttccgtagcgtcactggttctcactggttgcgcctgtgcttagtgattgcaaaataatctgaatccacccctgcctgggatggagtttattacggtgacaaaaaaaatggctggcttctagaaattatttcttgaggtaaaaattgactggaaaatattttgtcttgaaattacttaaaatgtgatccggtttgatgcaaattataagttatgcaaaaaatgtggaataataaaggattactcaattctaagttcaaaagtacatttatttaaaatgtgggcaagatatcaatataaaagaaaacagagtataagaaataaaaataatcaaagtacaaaacatttcaaatctttaacatccataatttagagatagcaaggtctttatttacaccattttatttctagttgaagtcccgtaacagttttgtgaaaacatttaaaaacctggcaaatgaatcataaaacctaatgtgggctcttaaagtcatataatacaaaacataatttatgtttcctcagaataaaattgcacatcttaaaaagatgcagtatatttattatatctgtcttcctgcttcacagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtagtgacctctgcaattctaaaccgtccactttgggcaaaattcatcaagctatggatatgaaaaaaggcccccaaggtaatactcataagtctcctgtatgacttttaaagcaatttcttctgaaagtaaatgtagtgtagaacaggctttcacaaatacaaacatgaatgttaggaaaaagtctggaaaaaatgcaagagtacatgttgtataaaaaccaaatgcttatagcatatctgtaaaaatttaacaggcctcttatcattcctatcagtagctcctacaataattttctaatagatggcggtatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagctctttagcgttaagaggaaaatgtttgataaatgtaattaactggatgaatgtcagtgtatttaaatgtaaatatacttaaatgtaattacctggatgaaacaggcacacacgaagaaaaaaaaactcggcaaggatgggtatcattctgacctctgcgccttactgaagcagtcctatcccaaacacaaaattcccctgcttaaggaaaggtccactgaggttgacactggtcagaggtggcagaggctcccaccctcacagagaggaggagctccagcctcattgcaggaggcccagggagaagtcctgagaacagccctgagagaaggtgctctgcaatgggaaacggaagtggaaacagaattttcccataaggacctgtaaggcatgttttgcttcactgataggctgttcctacattaaaataataattcagagatttttaataaggaattcaaataacagatgatgagctttattttttcctgaatgtctgaaatagaaaaaagcctaggtgtcaatattctaaagactgacctttgcattttcctgacatgttgatgaagtattcattctgccgcttccatttagtagtaatttatctcccatcccaaagttcctgagtacaaagactatatacgaactaaatttcatttggaaaactacaaactcaaaggtgagctgataaaaagaaacatatatttatttttgcaattattttctattttatctaattgtcaaattctttaatacctccataaactagacagtatagatcctttctaattaacatcacctattaaaactgaactctcagtaagttaagagaatatttttactagcaactcaaatgaatattctgaagagaaaagaattgttcactgcataaatcacaatagcaaagaaaggaaaaatggcttgcaaaacaggaaaggtactgccttattaacctgggaaatccatttcatatctaacccgtctactttttaattctcttttggaaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggtgtgatgtaaaaatattttgcctaaaattaaatgaaaatatatgtattatgttcttaa

SEQ ID NO: 1113 - DNA, 2272 bp, Homo sapiens
tgcgcgcggcggaggggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgccttttta

SEQ ID NO: 1114 - DNA, 17070 bp, Homo sapiens
cagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgggtatctcagcaatccttaaaaatactcgacttgcatctgtacaggctatatccccaggccacctgccccacccccacacttgtagaaaatggaactttttgtgtttgggagtggggggagtaaactgggagagtggaagaaagcatcagagatgtactttgctctgacatgttccctctcacagggctaatcatatcatgttccttctctaatgggttgtttgttaaatatacagaacacgaggagttcagactgcgtcattctgcagggtcccctttggcccccaaattctatggatctataacaccctttagaacatctgaataagctggtatctggggtacgctgattcagtacactggaaaaaactagcagcttccagcacttagaatgggggtgttccaggaggaggggaggcagggatgggagcatgatttgataagaagactgccatgagtcaggtgatgcaggttagcatttcatcctagtctattctttttctttgcaaattacagcagccggtttattaaaaatatggtatcacctaggttactgtcattctgtggcatcctcccgtcctgacgtaagactgaagatgttgactgcactagtcccggagcctgcatttgttatctgcttccactgccttagggtgttactttatgggtctatcccccacagccctattaggttgtaggtgtgactgaggaccacttgtctgccttcctgaacatgagtaaagctgcggaaggaaattaaaaatccaggaaagagaattccctagctctctatgagaggtatttactgcatgacaaccactatagcaacagcgagggagcttttctcatcttctcccactcctgtttttttgttaactcttaataatctgaccctacgactcatgattctgcaggctgctcccccttcattaccaaggaagattccttgaatctaattcacacatttaggttagaccagaagtctacacagtccccattttctgttgttggctctgaaacaagaaagtagtttaaggaagcatatggagtgcatactatgggtttggtgcaagaggtaagcgaatgatagagatgttgtctttgcccatgaagagtgtggtctagggagggaaatagacatccaccctgagctctgtatatgctttctagagtcagtagctaactctaaccatccccagtcagtcaaacttagagggaccagaggtgtagctagggaaaaaggggagagggcatcatcctagaggaaagaagaaaacgaggggtcagaggctacctgttcttttacctatatcagcatttctcagcgaagggtaatactgccctccaggaaacatttgggctgtctggagacattttggatgattaagaattgagggccaggtgcggtggctcacgcctgtaatcccagcactttgggaggccgaggcgggcagatcacaaggtcaggagatcgagaccattctggctaacatggtgaaaccccgtctctactaaatatacaaaaaaattagccaggcgtggtggcaggcgcctgtagtcccagctactcgggaggctgaggcaggagaacggagtgaacccgggaggcggagctggcagctagccgagattgcgccactgcactccagcctgggcgacagagtgagactctgtctcaagaaaaaaaaaaaaaagaattgaggatggggtgttaatggcatgtagtatagagaggtcagaaatgctgctaaatattgcacaatgcacaggacagcccctcaacagagaattgttcagaccaaaatgtcaatcgtactgaatttgggtaactctgatctattagatttctaagctgaacaaagagtgctgatgggtaagaacactgaagcttccatcaaactacctgaagtgaggttccatgtgtatgagggtccactcaaattccagaccaggaacaagaagactggtcacctccaagggccctccttttatgaatcttcctctcccctgatgtttattcaggcaaatataatttacagtcagccctaaacacagctttagaaggagaaagttaattacaattccatcccaaggcttcctgtaaaaggatgaagggcactctcatttctctgctttggtgatagcagaagcaaagcattataacatctttgtgctttttatatagatacacacacacatatatatacatatgtgtgtgtgtgtatatatatatgtatatatatatgtatatatatatatatatatatatatatgtatatatatatactctcttctctctctacttttcccagatcagttttttaaatgggccccttggcttagcaaaaggacccaaaataatccagtactctaaatataatatggggctgcctctgtccttatgttatgttgaagggttaattacaaaccaggcctcctgattgttctgtgataatgggagtgggtgtcaaagtttctaaatgagttctaccactagctagctgttccctggggaaaccacaacacttctctcttgtttctttatctgctgagttttattcaaatacatgccatgaaatcctaacctaggtcagacattgagctgggatctggcaacacaagatagataagacttgcccttgtcaaaggaagaggaagccactgctagagatctgaaataaaatgacaaagaaaaatgccttccttactagagtgagcgggggctgtgctgtctaggcacagtttgcctaagaagagcagaatgctgacctgaaactgcgcttttgggaggtatggagcctcacggattggtggatttttgagatgtgggtagatgacaccctctgtatgagaagctattgctgattggttgttcctccaatgcgtatttactgaaatgagtccatctctggtggcctgactttcagaactgaggggctaacaccaataatctacacaggtactatagacatccaggaggtagagacagtgtgaactattttaccttctattattctaaccctaattgccctcccatccttattcattctatatataattaacaaaattaataatcctctgactctcaaaattataggctaccaatgatactgaagctattcatatatttgattcctgtatgatccttgcagcgacctacacctagaagagaaacctatgcaaaaagactctatacatgtagacaaacaacagcaaaagcaaagcaagcatcagtaggatacgtagatgaatagcatgacaccatttgccaaacagtacaccttcatgtcaagaggtttgaagccttttacacagatctaagacaattccctaatggtaggtctcttaatcaaagatctagttacttgacacaaacacctcagccttgtgaccttatatgagaacatacttggttacaaatcctaagagaagaaaattttaaaatatattgattgagatgagttgcccttgatcagtagactaagtctaaaacttgttccgggctaaagagcactcagtcttttcctaagtgcgtgggaacattttcttctcagtctgtctgtgttggtcctcattcagccaaagctgcaggagagatctccgtgattatccagattgtcaccactgtttttggtcctcttaatgatgaagtttcatctgtggagatgtgatgttcacattgcacgttgatcaacatgagtttatgctattttttagatcatctgttgaatcatctgtcaggacagagctctgcagaagcatgtaaagttccgaacaacagatgctgaaggactaccagataaacaagaataattataaatattgtaagaagagactggaaaatctcccaagttcttcttcttagttccagtgccttcttagtcaattctttgttgaggagctgtccttgacccaagacttcccagctttgatcaggaaagcaagtcccaaaagtttcttgtgtatctgttaggtagctatgttcctttttcttctagcttaaatatagattgttttgcctctgtcttaatccaggtacaacaagaaatggtagctatagggtaaactcttccatgactggccacaaggaaactgaaggctattctattcatcatgactatttgggttaattgttgtggcctgggagcttaggctatataatattttatgtcagctaatgcaggcattatttactatgacaactttaaaaaaaaaccctctagttatccaactgtttaaatggggtcattatcttcaggagccttctctgagagagttttgtccctttggactcttcataaggaggtatagtccattgagggcattggcgagccagattttggaatggcctaacctatggccctatggagcaattaacttttcttctcagttgacattgagacacttaacgtcagcataggataaaggacccaggaactatagaagagaggtgatcaatcttagtgaagctgtaggtacgttatctgtaagtattgccaagatggtcactaattcacatggtcatctgtttgtcccgaggttcttggtttaatggcaatgtccacacttctctttctggaggttccctggaggacctcagtttagaatggtttggggtagcatcaagtcatcaaataattcacatttgttgtccatttttagagtacctgaaggagatgtttctatagtatgttaaattagtgaattattctggaggtatactaattattagtctacatacattctgtttcatttttttaacttaatatggacctactggaaaggtccataatttaagcattgaacaacttggctttgggtaagaaattaaattttatgggagagactggactacttattatatatcaaacatggtattgttatttttgttttttagcataccatcaacaaacaatatttcattggaatttggtactagaggatccaagttctgtctggagccaggacactttaattatagaaatgcagttatgggattccccttccttgtctaagggtttcctagctgcggggtgatgcatgttacaccaggagaaggagaaagtaaccatgaaccattatcaatcaatgagtagaaaaatattggatagtttctgttagcaattggggcttattacatgtggtatataagatttaaaggcctaataccaaatgttctgaagatgtgttgactagttgaattgatgcctgtaatttctctgagacaagaaggcaaagcctccaggttactgaactaagcggtgaacttaaaataagcaatgttctttgacaggtgctatgctgtcaccttaatccacccagagcatggccccatattttcatattcgcatgaaaaggaatgttcatgataacctaggaagaatcattcttaactcttatgcattctacttcaattaaattttctagttgtggagtctcttgtccatagagattctagaaccatcagtatttctatagtaatttttaaaattacatgcagtgtaggcattctcacgtcagatcaggtataatctcatcatgaacaagggctgcagcacattttatttggaagcagatcctacttattgcaggtatgtcatagattaaagaagtattcttttgataatgatctgaaaatatcagttataagttggcacacagaattgttaaagattgttactacttgaattcttccattaagtaaagttgattttctctcaagcctttgaaaaatttactatatagccagaaatttgtcaatttgtcattcattatcttgtttcactatctggtataacctataaccaataggttttttttttgtttttttttttttttgagacagagtctcacactgttgtctaggccagagtgcagtggcataatctcagctcactgcaatctccacctcccaggttcaaatcattctcctgcctcagcctcccaagtagctgggattataggtgtgtgccaccatgcctggctaatttttgtatttttagtacagacaggggtttcaccatgttggccaggctggtcccgaactcctgacctcaggtgatctgcccacctcagcctcccaaagtgctgagattacaggtgtgagccactgtgcccagccaccaatagctttattgaattttttgtttgtttttaatttttaaaaacttgctacaattttcttttttgcttttcagacaactttaaaaatgtacatggaatgatctgttgttctgtaatagtggggttactggtagttatattgacacccacataaacaaaaacattatatagttgtatatctagttacagaaaattctccttggaagtttaaaaagacaaagaaattgttgagtgacaataacttccttggagtggctttattagatagattgtatatagttgtcattttgctttttggccaacacgagatgttcattctttcaagggtcctcctgctagcaatatattaatatatacagggatccttatctcagctctcaaatctttgagaacagaggcccttttggatgccttatctagaaagccatatcttgtattgatttatagcatttactttctaagcctatctggaaatgtctagccccatattggatattttgcaaattggcaatttcacatttcagtttattttttcttattaaattcccaaattcaggtttaagcccatttatagaaagatatgacaagactatacttcagctgttgggtatacacaaatatgctgcttgaaggttttctgaagtctattttctatctttattcagcctcccgagtagctgggactgcaagtgtgttccatcacacctggctaatttttgtattttttatagaaatagggtctcaccatgttgcccatgatggtctcaaactcccaagctcaagtaatcctcctgccttggcctcccaaagtgctgggattacaggcgtgagccaccatgcccagattcatttagtttactttgaatctttattcaacctctccttaaaagaaagccttctaaaattactttacataatatattttctatttttatatttaaattttcacaactgggttatataactcttctattttctgtgcttctttttttttttaccattttttcttatctaagaggattttagttaatttaactaattagtacacatctatagttcaagaaaataaaaattttgtttgatattctaacaaaattataaattctataacaaaagtttagaaaatttttctttctttttcttcctttcctttcttttccttcctttcctttcttttccttccttcttttcttttctttctttttttgaggcagggtcttgctctgttgcccaggctagagtgcagtggcacaaccgtagctcactgcagccttgaaaccctgggctcatgcagtcctcacacctcagcctctgagtagctgggaccacagggatatgccaccacacctggctaatttttaaaatttttgtggagatggggtctctctattgcacaggctggtctcaaactcttgacctcaaatgattttcccaccttggcctctcaaagggctgggattacaggcatgagcccccatgcctggcctagaaaatttcttaattatagctcttagctttagacaaaggttttaattaaattctataaatctgatttttcttctggtaattttataatgtgattgtgtttttcctgagaaaaccctggttcatttaggaagtcagataaagctgaatagaaaaatacaagatagagatctgcaaagaggataggtttgggaaggttacaaaatctttgagactatcttagttaggattttcttttaaggactcaaaataccaattaaagaggctgacttttagccatttgatgtttgtctcctaatttttctagagcttctcttaaatatcttaactcactaatttttcattcatcagatgtttttcattaagtaaaaaaagtttggcatttgtgaagaaaattgcaagacttaggatcataatgcaattttaaataggaaatagaaattcttaaaaaagaggattgagatttggacataaacaagccgtggcacatgaggaagaggcaactgtggttggtcaacagttcatgcttgtgaatagtgtctcagggtcctggaccaaacagatggagaaggggacacatgattgtccgcacaactatcattaagctggaaaacaacaggacaaagtgatatattttcacaagtcgacaagtcaggaatgccctcatacgagctttgtaggggaccccaagcaaagtttgatcaattgctttttcataaattggtcactggcctaataatggtcttcaaatcattagccctcaggtccagcttgaattagattggaaacttatcaagccaatgccttatagaatagttccttctgtattcaacagaagaaggagttccaggacaaaacaaaaacccatgcaacaagactttgcacatgtagacaacacacaagcaaggcaagaggccataggataagtagattaatggcatgacaatatttgccagatgatacaccttcatggcaagaggtttaaagctttctacatagatctaagacaattacctaatggtagataggtagatctctcaatcaaagatctagttacatgatacaaacacctcagccttgcgaacttatccaaggacatagttggtcacaaatcctaggataacaaaatacattgagcaataagagcccagtgaaactaggcagaactcaaatccttgttgagactgatgtgcttggctgtggacacaaagggcaattgagtttggggcccagtgaatgcacttgtggcccaaggatcccacggagagtcttcaaaatgacttcaatggagcctccagaactgtccaggggcgatgccactactgctcagagtctgagatagaaagacaaagctgaatctttgactcagaatagcgagaggaagctatgcttgtcagcagtctcccagagcagagcggaatgcccatcatccatgattcggggcagtgtggggttcagagactggaggacactcagagtagcagcaggctgacatcagctgcagaacggagtttactcagaatgaggctttctgttggatggggttttctgatggaatggggttttctgttggatggcgttttctgttggaatgggattttctgctggaatggggttttctgttggatgattggtgctcagaagtgtgtttattggggtgagtctgaccttaattggctgactttcagaagtgagggctgacacagattagttggtttacaagtgtatattcccaaactgcatcatccttgattgactgaagaggtttaaacaagaaaaacgtctgcttgttatcagttatagaacaatcagtcttgtcctaagtttgtggagggttttgattcataccctcgtggaggcttccttgatgtgtaaggccatttttagcttaaacatttttattgttccattgagctcctgtgacccatctctcattctgacagtgatgtggtctaacttgcaaatcacctgaaaccacacttccaaggtaagagtctataccttaacttcaatacccattattgaaggtaatccattgactatctaggacattattagacaggcaaagcagagtggttggatgaaataaaagaacataccagatttgtgattaaccagtaaataattatttagcatgcaatcattttggaaggatgaaagctctaacacatatgtacctgtccccaaagaatttgtttattgggggagatgaggctaagtgttcatttagaaaaaaatttatatatgaatcttaaattgtgagctatgtactttatgtgcatttcagagattattaggaaaaattaatttggcttaactattcactttttaaccctatttcctctctttctgtgagtttactaatgatcaggttgaatgtagtaattaatagagcgttattgtccagattcaattaagtgctttattgcaatcatggattagaagagagcaaagagctaaggagtacataagtccaagggccatagagtaagaaaacaattccaccatttgagggcattagaaacctgaaactccacaaacaaccaagaccctcctagcagctggagactctattgtcccaggggtaccattttaaatcagtgtcactctttcttctgtcaagtgagttggcattgaatgcagcaccaaagatggcccagtaaaataatcaacatttcacaaggtaatagaaaaatatgcttttctgaacaacgtggagttctatgactaaactctaaaaaaattctaagccctaagtgtcattgatatcaccagtgtgatcatcaccactgtgaacagtatcttcagtgtgaccagcatctccagtataatcagcatccgtggtgtctccagtgggaccagcatccccattgtgaacagcatctccagcgtgaccagcatccacagtgtgaacgacatccacactgtgaacagcatccatggtgtcaccagtgtggccagcatccacagtgtgaatggcatccatggggtcaccaatgtgaccagcatccacagtgtgaacagcatccatggtgttaccagtgttaccagcatccacagtgtgaatggcatccatggtgtcatcagggtgaccagcattcacagtgtgaacagaatcttcagcgtgaccagcatctccagtgtgaccagcatccccagtgtgaacagcatctctagtatgatcagaatccatggtgtttccagtataaccagcatctccagtgttaccagcatcctttatgtgaccagtgtgataagcctccacagtgtgaccatgtctcaagtatgaccagtgttaccagtgtccccattgtcactcataaaaatgtgccaaggggaaggagactttccagagggttgaagagtccagctagaattcttgttttattgccgtcttgggacaatatggaaaacagcttccctgatattattagggggttgaattctgttaaggaaactggtagctttccctctttcctttatgctgaaaaattaagctaaatatggtttggatttctataaatgaatcccctcaaatgcatttccagatatgccttgataaatcagtaaccaaaggtaactctggtttcatctagaggtacagaaagtgagattttcaatgcttattttatatgtgtttttaaagtttggactattatggaccattggtttcattatttattatcttcttttaaatttaatctagtgtacagacttgatgttatactgttttgcaaataaatgtcagcaaagctcttctacaaatttggtaatttattcatcaactaacattgccttaaccatagtgttcctattttcacctgttattccatgtgatagtaagtcagttcctttcgagtccactttataaatgctgccaagaattagttaagtgggttagattaacctgacaattctttgcctcaaagatcgtatgctctttgagaacaaactgagtaaatattttttaaatgtactagagtcacagtatgctggagaggggaagaatactatttaatgttaatgcagtctcactcaccagagaatgaatgactcagaaactgtcgcacattttgattggatcaattaatttgctaattcagtaaatttatgattgcttcatatttaggctgcctcatcagtagacactcattatatcagttctcccaagagctaaaaataggaccagaagggaggaagagcttcctttcccaggaattccactccttgagagaaggaagtgaactggagagcctgattctgtgggaacctgccctgtggaggccttgggggcaccccacaggagactaaaagactagggtctcagttttacataaatataggggtagaggaagacacagaatagacccagagagaggtgtccttgttactggaccgcctcaaacagtagaatatgctatggggcacagcagtaggagctttatgccagaggaaaagttctaacattatagaggggacttacgtgagcccagaaggttataaagatggtagaaaatgtggtcctaagtgtacaggattttgataggaacttaggacacttttgatgaagtgtgcacctctgccactaagttgtgcatgccatgttgcctgctcgtttctgccactgcctctgttgaacagacagcaatagggagtccatcttcatgatgtcaatttcatcacatctggtcctttcatttctaagaggtaagcaaacacctcagctctgttgcctggtttccatatctgagagcgagtgccacaggccttcaggttcccacacctatccatcgaagactttcccttgagtggatgtgcggaatccaggcctgtcagtgtccaggctcagcctagcaggtagactgaggtggctcctcataaagctcctgcttgtcttttacaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaagtcaaggcaaataagaaggaggaggtaaaacaatatgggcaggttgagattgaatagaaaagaatgaacaagtcatgatgtagacctctgagggtaggagaccatagttccaggctttctggcacagtccccatttcaaatattctctgtggtcctagtacatatatcctaatactgatggggtatgacccaagagttgaccacaaaacactgtctccaaatatattaaagtatatagtcctatccatgagagcagggaatcttagctttaaggttttgtttgtggcaaccacacacgaacatacacacacacacacacacaactatgaaagaggcaggtgttctagctagctagtttactccaaaatgcaatccgttgacatgaaacaggcactgagggtaactacttcctttcattttgaagcaacagtttataaacaggaaagtctactggtttcatagaatctgtcagatttgtttatttgctactggtttcacgcgcgtggactatattccagtgtttctagtcaaagacctttatcctcaaatcatgagattagagtaaaacaactgctgtaaggttgagcatttcatgaccaatgactatgaaggcacattcaccaaacacaggcactttaagggcatccttgattaatttgctaattgctattttttgttggtatgtgaattcctgctaggaggccgaggctagtaggcaatgaaaaagacagaacaatggtaaaatgcagccccagtcctctacaaattgacagtataatttatgaggtgaggcagttaagtgatgatgcagcatttggatgatcatgtaaaaccagtgtcattacacaaaacttaaaaaaaaatcctaggcaataaaactgcctgtggtctgctatgtctctgactcttcaaatgcatgaattaaagaatgatataataatctctgaattattgtaattcatgtagtatattgtatataataaattatatcaattaagagttcaaacataggaaatttgtgataatttatatgtggtcttggcttgaagtttagtcttgtctttattgcaaagactagctttatcaaaagaatgtgagcagataaagaaatgttagacacctgtgaagtcacaattaatatgctaaatgcagatctttatgcattcaagcagattcattgagaaatttagtgataagaattgaagaatttatttagaaacgtccttagatttttcatctgtatatatcacttgaagtgctaaacccacaagtatttaaaatacagactcttcacttactcaagttacttttccccattattactcgaaatcagagagaataacaaatgctattgttttctagtgttttgaataagggaagtgtttgaataagggaagggaagtgtttgaaaaaccttattaagtaccccatggcagagaagaaaaattcagacatgaggagtctggagaggtaacactagaatcaagggtaaacgcttaagtctattctacctgaaaatccatgtgaaaacttttaatccataaatcgtgagtgtcttactgtttaaaaaagttcatactcttcagtaaagcgaagcttgaggaagatgtgccacatttttctggtggcttcaaacactccccaactctccaaggattctgtataccccagttggagaacgatgttattataatattaattcaatctccagctgagggttttattaatgttttcataagatggataagcctcattattcttatcactcaatatgtatttaacacctctcaggtgtcacttaaattatacattatatacaacatactccacatacactatctagagcaagaaacattccacataagagaaggaagaagtggcaattaatgaattattttgcttccatttcaatagtaaaagttgtttataccctggtaagaaatgtagacattcattgactttgagtctctactatgcaaatcaaatatttgtgaaacactctcatttatgcttgactgctaatattttatcaggttagaaatttatatgaatcataaacagaagtaattgctcaaaataactaattgtgttcccgtgccagattgcaacaaccacctttattagatggtgcacctagagaaggctggagggtttcctgcaagccctctctgtagggtgactgaggtgaaccaatccaaagccctcctttcagctcttgtagaatatgtcgaacaaaacgcacagttctgccctcctgcctaaagacaaagtacaaaggagataatcctctccttatgagtgatcttagccctcttgaggtcactatcagttttatattttcattgtgcggtagtgaaagacaagtggaagatgtccctgagtctgtattgacatcagaccatattgtagggattaattcttgataaaaaaaaagcttgttatttctctcttcttttcatgaggagcatttttgcttccgtgtttgtctgttggatttgcagttccctgctcacagccaaagaggctgtagagacaacactttgccatatttctattaaagagaaaataaagattgagtccacagctcaa

SEQ ID NO: 1115 - DNA, 4491 bp, Homo sapiens
ttttcaacatatttgtgtatttgtttattaaaaataaaataaacccattacatgtctatataagtgatacctcattatgaaaaataattatttttcataaaatatttctgaatagcattaacatttttgcaaatctcttcaagacagctagaacatcatatgtttctacattccatctgttgggatatgttattttagtttaagattgtgaagaacatccactttcatacagatatacagcagacaatagagtactttaatactattttcagataattatggatattttttctgtgatgctatattaaaactcaatgagtggtagcaccttaaagatttgttgtgatgtggaatctgaaattgtatcatgcatgtttattatgctgttacattaaaattcgttggtcttggccgggtgtggtggcttaggcctgtaattccaacaatttgggaggctgatggggatggatcaattgaggtcaggagttcgagaccagcctggacaacatggtaaaatccccatctctactacaaatacaaaaaacttagctgggaatcgcttgaacccggaagatggaagttgcagtgagccaagattgtgccactgcactccagcctggatgacagagtgagactctgtctcaaaaaacagaagcaaaaacaaaccaaaaaatcagctcctacttgaatgaaatagattcataccttcccattatagaaaaatctaaaataagtatttttctataagccagtgacatgacttgattacaaaccgtaagtaacctcaatagacaactgagtctgcactcgaatgattgctagatggctgcaaactaccttttggaaaggttttagtagatgtcccatgatttgtttatatgtctataattccctcttctccagtatagcacctcgttcagttatgtggttgtatcttttgctagtatcttttgtcggatggtatattagcttgctagggctgccataacaaaataccacagactgagtggctcatactagaaatttattttttcctagttctggcagctggaaatccaatcttgatatcttctaatcttccaatactggtatcttctaatgtctctctccttggcttgtagatggccaccttcttgctttattctcacgtggtctatcctatgcacacacacatccttggtgtctctttgcatgtctaaatttcctcttttcataaggatgtcagtcagattgaatgaggccctatcctatggcctcattttaacttaatcatccctttaaagatcttatttctaaatatagtcacactatgaggttctaggggttaggacttccatatataaatctggcagggggtaagggaggggggaaggagagacacagtttaacccataagaggtgacaacccaggaaggtatatttcccaatactgccatttcagaggtaccatatggcagacgggagttttataccttttcagattcttttccttttcagtgtttttcaagataaaattggggctatgctttaagatgaagctgaaatattatgattttttatttgtgtatttttaagagataagccagactttctgaacagggtttgtcccttctggaaatgctccattggatctctcctttgtgggaatattctattcagtccctaaatttatgacactctatttttcacaaattatcctcagtcatccttggctttgtccttattaactattctgctgctcacttagctatcaatacagacagctgtggcctggggaatcagtagggaatataatcacaagcccataatgcctttcaagattcatagagatccattgaggcccgcctgtgggcaacacagttcatccattcctccagataacaggccctgagactagatgcagaactttttccaaagaagaggattcatagtttacatctcattcccattagttccatgacctcaagaaggtgatttgccttaaagaagcacaagcttgcttccagattggggccatgcacagttgctctgcatgcaggcagtcaccatcagctgtttttaagtggtgtttgaaacagccctgtgaataatccggtatttaatgatgttgtcccgtcctctaggttccagtggaggactttctcttttctcagtgcattctcctgatacttgttttactctgcaagaaacaaaatcttatatgaaaacatgttgctaatctttaaatagttaaaactttctgactaaatttacttgtaaatgcacaggatttcacgacactcattttatatacttaaaaacaaagcttattaacaccttacttttttcctgccatttctgtccatcatttttaaaatttcaacttcttttatattgctatatcatgtgcctctttatgaggtgctttcaatcataatttctggttagaagcttctgatattttctcagtttctgtggatgtgtttgtggttgttttgtgtgcatgtgtgaggggagagttaaattacctctttcttttgagtgagatggagctcttataataacttgtatcccaatttttccttctcaggaagcaaatttagtagggaccactggagactacccatctgccttatgactctgaggagataaagcattcttcagccattcctgttggagccaggtgaagcattctagctccaacacctcaaccatctctaggaacagcagcaactgctatctcgcctctcctcctttaaggaaaacaacccttaagggaagcaactgagagctgggtaagaagaaagcaatcacgtgctaaaatcttccggagaacaaaagttagtgaaactatcttagacccctaattcagaactcttgcaggaagagtaaatacttatggaaagctgagaaagcagtgtctagggcctccagtccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgcgccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgt

SEQ ID NO: 1116 - DNA, 126305 bp, Homo sapiens
tagctacatccgtcacctgacacggccctaccaggaacagccgcgctcccgcggattctggtgctgctcgcgtccccgctcccctattccccttattttattcctggctcccctcgtcgaaagtcttccattcttcaaactagattatttaaaaatgaaaaaggaagaaaggaaagcgaggtcatctcattgctctatccgccaatcaggaggctgaatgtcagttttgaactaaaagccgctccgctcctcttctagatttggaaaacaagcgaaattaaactaaaccgctgcacgcctctgacgcgacatctggacacggcgcggcgctggcgctgccggagctgtcgacccggcctggcgccggactaggtaggtggagtcgcacccgggggtcccagctgggtccgggcgcccattcccctcccagctgcccgcgtcgccgagggcgcctggctgggacaagcaccgagtcctttgtgtctagcccatttttattttcggttttaaccttcacgacagccgcggagcatctgagcgcttcttcctctttcctcttcccccgcgctcccctcccctgctggccgctcccctcctgtcgccgcgtcctcgcgtagaatggttgtcttggcgaccgttggccgctgccgcctccacgctctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcctcagaaatgcttcccttttcaggcaccctcataccaccgtgatttttttctttatagcacttaggacgaagagattattttacttatgtacttgtttacttgtttgttgtgtagaatgtcagctctatgggaaccagatccttttatgggtcttcctctgcacctatgccacgcccccagcattcccctcctaccaccaccttcagccggcctccgcctctgtaggggggcattaggttttctgtcccacagaggaagggcgctttagaaagggttagttcatcctggaagaaaaacgatgtcggatgccagcatagtgtcatttaaagatactggaggaatggagtgggagcggtgagggtttcttgggcctagacaatgtaactagttgttgcaataaagcatggtggggaaaggagaaaaggcacgtattaaacatcttttgaagtcgctatctatatcagtcagttctccagggaaacagaacccattgtgtgtgtgtgcgtgccagtaccacacatatgtatatgtatatacacaccgtcatggggttgcttaacaacagggatacattctcagacatgtatctttaggcgatttcattgttgtgcaaacatcatatacaaacctaggtggtatagtctattatacatctaggctgtatggtatgggctattgctcctaggctgcaaacctttacaacatgttactatactgaatactgtagataattgtaacaaaatgtagttttatatctaaacacatctaaacatagaaaaggtagtatgttgtgctacaactttaggacagctatgacatcactaggggataggaatttttcacatccattataatcttatgggacaccaccaatatgtgactgtggttgactgaagcatcgttatccagcacatgactctgtgtgtgtatacaattttatatatacgtacattatatgtctacacacacatatgtgggggagagaaagagagggagggagagagagagagagagagagagaaagagaaagagagaaaatacttattttaaggaattgtctcagaaaatggtgggggttgacaaattggagacccagggaagagttgttgttgcaagacttgaatccaaaggcaatctggaagcagaatttcttcttccttgagggacctcagtcatttctcttaagctcttcaactgcttggatgaggaccacccatattattgaggataatctgctttttcaagtctactgacttaaatgttaatcatatctaaaaaatacctccacagcaatatttagactggtgtttgactcaaacactgggtaccacagcctagccaagttgacataccaaattaactgtcacattatcccgtcatgcctgaggggttctctgaccctcagttttctgaggatcaaatttaaattgagggatctatctttgtttattggagccatatagctcaaagtataatcattttctctccacaggaactagacctagggataagggtaattgcttatttcagaggaatgccatctgaataaaaggataattatatagtaagctctctgttcaaaaaatgtaaatattaaagtttgaacatctaaattccatcttggtttcccccactgccgctgcccaatacctgttctctttcagttgcagtatgcaggggaattctaagtttaatattagtctcagcaaaatacaatggtgaagatgactctttctagcataacaatgggtatgtggtattccaaatacttttggaatgcggagtgactattggctatgtgctcttcaaaaaattaataatgaagaactgagcatgtaatttcacttatattacttattttatcctcacagtggcctttcaaaattgggattattactcctgttttacaggtggaaagaatgaggcctagaaaggctcaaatcttgaacacttcatggccagcaagagccagggctggaatcatcaggcaggcctttgggttacaagccttgtgccttttctgttgtcccaaaggccagggtcaatagggagtgagttatctgtgggtcacttatgcagacagaatcactgaatattggaagtttttggggttctcttccactggcctaaaaacctgagttaattgagttttttttaacaggggtaaataattttctgttttagatcagcaaattcattccataggcagggataggggagaaaaatcttactgaatatcccttgtcttgttctcctcctccccaaacttaatgtcctatgacactagctttatcccttaggtaactcttgattatccaaatttcatgagaaactttcctaacattgcacatgctcaaactcaaaaccccaaagtcataagaaaaaagataacataagcaagaataaaaaacaattatttgatcatatatgtcaaaagattaattactagactatataaataaatacataatccagtaaaacaacaatccaataaaaaaggcaaaggatataatagtttatagtagaatatgtgcaaatagtaaaaaataaaaagataatcttactcattaataaatgtaaacagaaacaatggcatataaccacaagtgtggcaaaaagaaaaaagactactttgacaaagttgtcaggaaacaatcactcttactattacaacttggtgtaattgttttgaaaggcagcattacaatatctagtcaaaactgtatgagaatataggtaccctttgactcagctattccactattttaagtatgtaaagacacacacaaataatgtatggaaatatatatacacatatatactatatagtatatatagttcatatgtatgttatatgtttgtgtatatatctatatacttatatacaccctttgactcagcaattctattcctataactcatgtatgtaacatatataatacatatctttatatacacatatgtacacacatatctgtaagtatgggaagatgtatacacatgtacacatatatatacatacatatgtatatatgtattttatgtatggatacatatgtatatatggatagattttacacctacagacacatttagatatgtaacttcagctaaagcaattcactcctatataaattgctacagataacttgtataagtatgcagaaatgtttctttatagcagtgtgtattagcaaacaaagtgcaagaaagagaaaaatgattgacatgcttgtgaggagactttttttgttgttgttgttgttagggctcattcataaaataataaaactgtgcatccataaacaataatgaagcacatctatatgcactgacaatggaagttgtcaaagatctattgctaattaaagaaagcaagtgacagaatagtatgatcccattcatgttttccaaatatgcatgctgggggagagatgtttgcaattatatgtacttatatttctggaaggataattaaatatttgtaatagtggttacctttgggtagtaagaatgagggtgggaaaaatttcagatttttgcttactactttttgctttctggactgtttgaaagtttaccatgagcaagaattattaaataacaaccacaggaatattggggctcaaacctagagattctaattttgtagacctggagctgatcaacaagtctaaatgttaaaacatcctcacgggtgattctgacatggagccaggattgagaaacaattttctgaaatggaaggggttttaaacttgttgtcctcaaatgactactgaggcaaacaccattcttatagacataagacatacttgggagcaaatgtataataaagtggtatgcttccctagaaaggggacgaccttaaatctttctgtttatggtggtatttaaacatattaaaaactactaattttggaatagtcttactgtgataagtctaactatcaaaggcagtccagagattagcaaataatagaggatgatcaaatgtttttcagaaaatattataggtggcactttggcaggagattctgagaatggtgagagggtgcctctgtgccctaggaaaggtgatagagcttagaaactcagaactcagatggaatgaggagccatgccatatacatctttacaacagtcaccctctagaagaaaactctgtgttgacaataatctgctgacttgtctgtgggtttttgaacagaataaactgtttcttcttttatgtttgtgtattattgcttataaatatattctaaaatatataataacaaacaataacagtacttgcagcttaattaaagaaaaaatgcaagtatcttatttatactaagagaagagagaaacccgaagaacaatggattatccttacatatttggtttgggattacattgagagctacctaaataccagacactcattcttggtcctgactcctactctgttatccatagctcagtacctagtatctggcgcagaaagaagtggaatggaattatcagggagacccagtttttagccaagactaaaaggttttagccaaggggatggaagaatttgtgcatagatagacggcagatgggaattcgtttaaaatggaatggagacccagaggtcacataagacagggttcagaggaagtagccccaacaacatcataatagagaacattgataatgagaggatagatagattatgcatttggggaggaggccaaatatgagaaataagacatggtttacttactgtaattggtcttaaagttttgagtggaactctgttgtaaaatattttctgtgccagagctgactccatatatctactggaagtctaatgccaggggcttctgagtgtgaagtggattaataggtgtttggggtcctttgtaaacttctagtgtaatgtgaatagctgtgaggtagtcagtgtgtcatcttaatacattgttcttagttctttttccagcaaactcttttgttttacatttagttcacaccacaaattagtaagtcaggcttggtgctttttgacccatacattaattttcattactgtgcttaatatacaatccatgccaattacatattattaattagtggcactagtattagttcatattttcttttattatgtaattaatagggcctatatgtgaaagttactgtgtttctgtaaaatgaagtattctttttccttacgcaaggaatgacattaaaatcttctgagtagggaatttaagaggcaagaaaggagtaatttcatttggatagctgaaattgagaaacgttttatagaaacttttcaggtatgaaggatagtagtagagatgttacatgagttagcactcatatattgaattagttaaggaaccaatgtgggaatctaggtcttctatcttccagtcaagtccttgtttcacttttcttcattccctctttctttcctgtcgttataagtagaataggaaaatattgaaagtattgaggctcaactgttgttgcccctttaagtaatttctaaaattaaaattgtcttattttcatatatgtgtgattgtgtatctaggtatctctttgtagcttagtaattgaacactgtgaactacaccaacctaagcattattctccaagttttcatcaaataactagacagtttctgttaatactgaaaatctagtaaacgtgtcagaatttggttatgattagttgctgacataaaacatgagggcagacctcactgtactttagaagatactggctttcacatttgccccagtaggtagttcacatgagtgcttcttcagataatgtctctaagttttgcatatcattagttctacttgctccacttttgatagagtggcaatgtattgaacattgtaaaaattatgctctatgatttaaaaaatccatctctggtaaagcataaaatgagtatatgttttactgtttaaaataattgaggggtaattatagaatcagcaaaaagaaaaaaaaaccctactgactattacatatcaatgcacacagtgtgttaatattttcaaaaaagggagggcaatctcagtgtaagtgtaaatgaaattagtttttgtatatatttgctgaagatcagttacctagcttcatatgataaattatttggtgctggtcacaatattgtgcttgccatattagggaaataaaatatcatgaaagtattcctaagtatacattttcccagaggcgtttggggttttatcagtctcgagctctcctcttgaaactgtttcattccttagttatgaaattactaattttaaccatttaaggcataggaaattttacatagattttgctttaacagcaaaacaccctttaaaaaattcatccacttaggtgaaaaataaaagataaaaatgaagccaaatgaatgttattaaatttataaatttatttaactttccagatcttcttggaataaatgtcaggtagtagaatttgtacaaaccttggtaatgtcttaggtttagatacgaacttaacaggtatatttaattttctgtattccacaatggagctagaagcaggactcatgaaaatagtaactatatgttttgcatgtatccttcaaagtgaaatccttaacaaatttaacagtatatattaggctgctgatgaaacagctaaacctgtctgccaggtggcttcgaaaatggaattaatttttacatggcattgataagttactatttcaatacaaccaggtggtaattgatacccaataatgtttgaggtttgctttaaataaaaaaaactaacaaaacaaacaaaaaaaacagtgtaatatagtactgtgggatccacaataacattttctttagtttcccttaatatcaggttgtcattaggaaagattccacaagttatttaaaccagaaatgaagtaacatgtttcatatctatttcaagggataatttttcatgacccagtataatgcaactagcaaatttaaacatcttggaatttaagatatagaggtcaaattaagggattttataaaccaaatgggagattttaaagtatcaactgacttcttttatatagaatgttttctaataattgtaaaatactgtaactttaaaaatattattcttgtagcctctaatgattgagtgcttaagtgataactagaaatatattttctgtccctgtgcttcagtttgaaaatggaggttccattatctttgttccaaaaatttgggtttttataggtgtgttggggggggttattctccatattgttgacattttaaaatagttttcaaacaaaccgtttatatttactagaagttagagaaagaaaagccaccttaggagcttacaagggagatcattgtgtatttctgcttttttttaaaaaaagttatcttcatgtgtatcattcatgattttggaggacaagctggtgcaatgggaagaaaagcaagacaaccataatcagctgtggaactagatgcacttctttgtgcatccatggaatgaatatcttgtaacctttggcaagttacttgatatttctttgcctcattgtcctcatctgggaaacaatacctatctctcaggtttaaatattaaattaacaaatatattttaatgcatacctggtacagattatgtgtcaataaacatatcctttccccaataacatatgctctgattctcaactaactttccccagtaatatgttcattttgggaataggaattggtagagaagtaaagatttgtgtattcaactcaaatgtactccttcttataagtctccactctcaaatgacttgtttctgttccttttttctcttttaaatgtgtatctggtagaatgagcatttagaagcataatacatgtatacactttgtgtttaattttctatggcataagtaagcagtttttatgaattgctggtattgcttatgagcaattattacaaacattgagagaagggaacccctgtgaacctttaacatttctcaggagttagtggtaaacccatgaacatgtatttttaaaccaaattacccacctcttggagttcaatctctgttaattctttattaaagtagtgaagtatcagttgttccaatgatataatgatcaagcaaccctggaaattaaatcccaaagcagtgcacctttagtttgttcagtgatagtaggacatcccacgagccatcatatattttcaagtttttatactcaatctactttttcagcaatcttttgggaactatcccaagataatttactgcataagtgcatctatcttctaaaagacatttggaatatttcttagtctgacctctgcaccctgagacactctataaaggaaacaatcagaaaaatttaacaaagaaataaataggttaagaagaaagcaatctaggcgtttgcactgagtttgcaacagtgccattgctacatttaagagctgtagttcttcctcacattttaactgagagccactagttatgttacttaaaatctccccattaaataagacagttgctgaacaactaaaaagtacaaaatatcacaaaatcaaaaagtagcaagtcataaggggatttccgcatcctagcatgtgtgtgtgtgtgtgtgtgtgtgtgtgtgaaagaaaacgttacagttaaccgttacaattgctctcactccactccaccacctcatcctgtgtagtctgcctgcggaacccgcgggaatctctcctcagtgtagtaagagcaaaggccagcatcctgtgcaaaggtgctctgcagcgtcgtgatccagggattttagcatctgtcgtcgcttgcacatcctctcttacccctctgctatctggtggagttgggcgagggtctccagggcttccagagagtgtcgtttacgcatgtgacttgccatgcgctcaaactaaagcgccgccggggacttactgaagcccacctcggccctcctccactttgtcctcagtcttcaggttttcctttctgccgctagggcctaagttgtgggttcaccataactcctcagcagacattggagtgaacgcatcgactgccgtcacccaagtgctaatcactgccttctcccactcagcgctggagtgggagattcatccatcggaagattcgtagccaccaggtccagtcaaggatttcatatgcactttccctcagaaaaccctgaaaagcaaacgacccctggaatgtcacacactcctaaatatccctggaaatccgcttctctgtgtttcgcttcatggtgagtgtcgagggccagataagacaaagaaaaaaatgtatggaaggttattcccggtcggctcctccttcctgtgagtctcagacaggcttgcaggcttacaggctttccgccgctccccgttggcagccttcatcgaattaggtgggtgggggtgggaaattgggtaagaaaataaagtcgttgtgggcggctggggaacctggcgtcagtcccccgtggctgtgcgcaggtaccctgcaacgtcgcggtggccccgctcctcggccaagtccacgggcagacgaccccaggcatcgcgcacgtccagccgcgccccggcccggtgcagcaccaccagcgtgtccaggaagccctcccgggcagcatcatgcaccggtcgggtgagagtggcagggtctgcgcagttgggctccgcgccgtggagcagcagcagctccgccacgcgggcgctgcccatcatcatgacctgccagagagagcagagtggtcagagccagggtgggggcaggtatgggagatgccggccggggcaaggcaggtggagccatttaaagaaacacctaattgcaaagttttcacccagtgcagaggtgttcaggtctctgatgtctggtgtttcttcatttgctgatgcaatccactttcccaccccaccttcaggttatactcagtacaaattaaatgccattttattctctaaacgtgcagagacaagaaagttgatggtaaagtgatgatcatcattatggaaaaacaaatcttgatttccattggaacatgggaatctattttgttaaatgatttaggggcagagttaaatttattcggcttttaaagttttaaattatttgccttgctgacccctcctccataatccaggtctacaaatatttattaggtagtcaactactgtttgttagaagttgggagtaatggtttaggggagaaaataaacaactaagtttttttctttcttttttttttaatttatttagttctcatagcaaatcccgtgcggaaggcttttgtttgtcatgtgtctgagctcataactggcttgtagtgtgataatttgagccaaagttggagattagaagggaaaagtaaattaaatcatgcaaaatcttataaaattataataaatgatttttccttaacagttcatcattttaaatttagactataatatttttaatgtaatataaaactaactatatttgtatactacaggattttataatagctaagatttaaaaatgttaaacagtaaatattttgctatataaaaagagcttgggccaggcccagtggcttatgcctgtaatcccagcactttgggaggccatagcaggcagatcacctgaggtcaggagttcgagaccagcctggccaacatggtgaaatcccgtctctactacaaaaaataaaaaattagctgggcatggtggggcgtgcctgtagtcccagcaactcaggaggctgaggcaggagaatcgcttgcatcctggaagaggttgcagtgagctgagattgtgccactgcactccagcctgtccgacagagtgaggcctcatctcaaaaaaaataaaataaataaataaataaatagagcttggatgttagcagtcaatcaggatgatgcataacttagaaaaaatgatgttttgcaggagtaatcctgtagcagccatttgtgtacatgaacattatgaaaacatttgctgtcatatttaaagtcaattataagacaatttttggtaactaaatgtctaaaatcgagttatttgttatgggtttatgcactttaaaatataccatttaattgaaaggcagtatacttctcatgttttgttggcttgtttcattaatattagaaatgttcatttcatctcttaaaaaccgtgataagttatatctactagtgatgtaaggatattttacatagaaaaaaaggggaaaatagctgctgttagtatttcagaaaatggtgaattacatatataacttgtttttataattattaataaaattttaagtttttaagatgcactttacaatatttttgctcctttaaaaatccctcatttgttataccattattctaagaattcaaaagaaatgaacacttctttaaaatctatactattaacaagatcccttaatattagcttagttttagagggtgatagtgaggtgagtactgaatatgaccactagccaacggtaaagtacaaaagagttgtccgagattgtaaaagaaataaaaaatatcagtactaattaaagcaggattcgtacttaaacattgaataagtgtattttaacaatgaagataaagatgcattatttatgaagatcctttgccattcaaaaaggacctaacagttgctgcaggaatatttttgtaatctgggcactgagtatgataattaaagaatgagaaacctatagaactatatattttttctcttatgcatcactcataagacactgctaacataaaaggaactaagtactgtggttgaggaatcccgtctcattctcaattaacctctatgagaaaacaatacaacagatttcatatagtagcttagaagtttacattgattttttccatgtactatgattttgtagaattccttaaatccaatctagaatgcgtaacttatactttacttatctttatcgttgaaagcagacagacaagataatcttcttccctaaataagctttccttttctccttttctccccaattcagtctattccttgcatctctgatcatgagatggcagaacaaaaaccactaaaaaaagcttaaacagtgggtttttcaatgtctctctttaggatttttgctgggtaaaagcctgttttacgcgtggaatgcacacctccggccaacggagactcctgtacaaatctacatcggcgatctaggttccagccccgatccgccgaggccgcgccccgcgttcgcgcgccccctgccggcgaggccctggggccccagctacctggatcgcgcgcctcccgaaacggttgactccgttgggatccgcgccggcttccaggagctgtcgcaccttctccactagtccccgcgccgcggcgctggccagaccctcatcgctgccgcccccactgggcatgcccttgttctcctcgcgcattccgcagcccccagacgcgcagcggcccggataatccaccgttggccgtaaacttaacgacactcttcccttctttcccacgctgctccggcgcactctctccttcctaggagacctgggctcagcttcattaccctcccgtcgtccttctgcggcttggggccccgtgcagtggccgagcggccggtcgttagctccgggcttttcctggcgctcaagaaccagcgggcgcgcctggattgcttctgggaaaaagcgcctagcgcggacgcagccgagctcaaagccgctctggccgcagggtgcggacgcgtcgcggagtcctcactgccccgcctcgctctggcagagtggggagccagccggcaaagaattccgttttcagctgggccaaggggccggcgtctccccacccccttaggctccgccccctgtccgctgtgatcgccgggaggccaggcccgggccgacgcgtcacgagggcggggaagcctgcccaaagatgctaggacgcatgcgccagagactgggccagggagccgccaggaatgctggctgcactgctcgctggatgtccagtaaagccaaggctaatattttgggaatgttcaccactgccctcagctcctaatccccagtaggcggagcagaggatttctgttccttcagccagccagttggtttcactgtggagacgttggtggctcccttgtgaccgagagaaagtcattcaaaataactccgtgtttcttaagatgtctgaaagcgacagctctgcacctgtcatacaagttaaattcatccccaggcagtacttgggcttcacaagtttcataacttgtatcaaacttagcaattttctcttggatgtgtctttctgtttgaattagtcaaccataaaaatagagaaaaatcccgagaatcatgttttgcgtgtgctttttaattctttccatttttgcattatggatacaacccttaaaagagaaaaaaactagttcgagattgagagtggcaacctggcacacataagacaaaaaaaaattatactttaagaatctgagatcccagtttcatcatatttgtacagtaaatctttgtttgcactcttacctatttaaacccactttgtcaggtatcttatttttatttatcatgagtaataaaggaaatttatgcagtaataatgaaacatcataagagaggggtgtggtgctgggcttgtcattaaacaggctgaacctgtcattaaattctcttctgaagatttaaatgccaagtgctttttttccccttcctaatcttcctaggtgagtttgaatcaacatttattacttaaaatatttaaaacatttcagcggatgctacattggataggaagagaaccgcaagttatggatttgttgcctaaaaactttggtgaggaactgcataagtggacctctcctaaaagtgaacaatttttgtttacagaatcattttggttcggagtgctgaggaagacaaagtcttaacaggagggcaattgcttgtgtattgcaaaatgagagtcttcacatgttttttttaggataccttagctctgactcctcatcccccaaatccctgtagaattaaaaaaagctctttcttttaaaggcagtggaagtgccaccaccatggaagtgctggttagggctgaaaatctactgacagagcctcaacagagctgaaatccacctggacagggaagggaaccgggtagcattaataacaatttctttttctttcccatccaacccccatttcctagtcttcagtttcttaatttctctaccttttactcttatgctcttgttttgacctttgagtttctctgaaacttatcagaaaagttaggacaagatagtctgacccaattcttgagccattttcttaggtagtaaatatgtcagaaaaatgaaagctgtttggagttgataaggaaatggaagataatgtttttctttgagggggacataaagaatggtgatagggaaagaaccaatgactaagtaaaatgactgagaatcttgcacgaggcagatgtgtgagcttcgcgaagcaagttgactgaatgaaaaacaactttgggtagggaaaacgttgccgggggcattcgcgcttactagcaccacggacagcgctttgcttatactcaggcctgggtggtcctaaccagctccagacagaattctaaagcttcacacttgatcttccaaagccccttttctcccgtcaaatagaaaggacattatggaagctcaatgaatttctttgaaaaaccaacctgctcaacctggttttcaaatatgattggattttatctaatattctctgtataaagaatattatatagtctatatttagaagacgagaagagaaatcaaacttattgtgtactctgtacgaagtgctttacagctgttgtttcatttaatactcataaaactcctctgtggcatgtgtccatatttcaattttacagacaagccaaaaggatcagagaatttgagtgacttgtatactagctaatcattgttggaggtgggtataacttttgcgacttcagagtctttttaccctttatactacatagtgttttttttagcagctgtcatggtaggcttaactggaaaaaagtaataaactggcttataattatttttcagtctacactgtgttttccagatggctcacctcacagcacacccttaccagacttcaaagatgacatttcacatgtaatacaatagcacatttgtcttggacaatagagtgagattatgaaacattttacctctccttgaaacccagctgtctctagggtgaaacacaatctgttgttaatgctttaaacacatttaaaagatgaagtggatgggaacatagtgggcagctgaaacttggaattgtcagagccatgtcttttaataaggtggagaatttataattgagaagaaagaaagagaaagttaatggtaaattggcatagaattttggaggtcagtagaagggaatgagtggcatccattccaatgttgcacataactcagatcactagtaataatatttttatattctagttggtgaaattgtctgtatatgaccttgatatagaagtatgaacagatctgccatcctctttttcttcagcgaggcagccgagctgcagacacagagatgcagatctttgtgaagaccctcacgggcaagaccatcacccttgaggtcgagcccagtgacaccattgagaatgtcagtgcgaaaattcaagacaaggagggtatcccccctgacaagcagcgtctgatatttgccagcaaacagctggaggatggccgcactctctcagactacaacgtccagaaacagcccaccccgcacctggtgctgcacctgcgaggtggcattattgagccttcactcttccagctcacctagaaatacagctgaaacaagatgatctgccataagcgctatgctctcctgcacccctatgctgtcaattgccgcaagaagaagtgtggccacaccaacaacctgcaccccaagaaggtcaaataaggctcttccttcctcggagggcagcctcctgcccaggccccatggccctggagcctcaataaagtgtccctttcattgactggaaaaaaaaaaagtatgaatagaactggttgactggccaagagaaacagcgacctaaccttgccctcatttatgcacacttttgcatatgattaggactaagatagtgtttataagtgagaagagaaggaaattcataatcacttttggggctttttcaaattttttatgaacacaccttcccaccaagaggtttgattttctccattttatgagttgggtttattgctccgtgatccacagtatatccacttctatattcccatgtatttttcaagattaattaaatggtggacttgttcatcattttagtatccgtattagtttgctagggctgccataacagaataccacagactgagtagcttaaacaacaaatatttattttctcagagttttaacttctcctgaggcttctcttcttgacttgcacatggccatcctactgctgcctcttcacatagtcatccctctgtgcacacgtgcccctggatctcttgtgtgtgtccaaatttcctcctcttttgaggacaccagtcagattggattagggcccaccccaatggccttattttaacttagtcacttctttaagggctctatttccaaatacggtcaaattgtgaggtattgggcttaggactttaatataaaaatttagaggtgacagaatttaacccataacaacagcatcttaatttttacacattttacttttcatttctttttaaactgttattaataatttattcatttgaataaggattaaaataaggctaggatattgaaattggttgaaattgctacagtctcttgtatctctctctctctcttttttttcttataagggacaggtttcattcaccttgtcgaccaggctggagtgcaatactgtgagcaagggtcactgctgcctcgaattcctgggcttaagggatgctcctgcctcatcctccagagtagatgggactacaggtgttggccaccatgactggctaatatttttacttttttgaagagatgaagtcttgccatctggcccaggctggtcccgaactcctgggctcacacaattctttcacctcggccccccaaagtgctggattgcaagtgtgaaccactgcacctggcgtcttgtttcctcttaatctacagtttcccccttttgccttctttttttttctttcaatttatctattgcagaaattggctttatctgtagttttctaaagcttggattttgctgaatgcttctttataatgacacttaacatttttctttgtcatttgtatttctcataacttattatttaggcctagagtctgtatgtgattcaggtttgatatttgggcaaaagtatttaataagtgggattacgtactttcaccaagagacacataatatggttgtctctttctgtgattctagcagccatggataattatttcatagattattattttcttggggatggcaaaatggtgatattctaattttactattccttcatttactagctggaatgtctttttaaattatttatttatttatttattatttgagacagagtcttgcactgtcacccaggctggagtgcagtggtgtgatcatagctcactgcaacctgcaactcccaggctcaagtgatcctcccacctcagcttccccaatagctaggactacaggcacacatcacctggctaatttttaaattttttgtagagatgagggtcttgcttttttgcccaggctggtctctaactactgggctcagcctcctaagctcctcctgcttcagcctcccaaagtgttgggattacagacataagccactgtgcctggcctggaatatttctatatagaaagttctcttcattatctacttcattgctttcaggtatatgtaagaaagacaggataaaccactagattttgaaatgtatttataaattttcaaaataatgagttgagtcctagaatctttcttttattattattattattatactttaagttttagggtacatgtgcacaatgtgcaggttagttacataggtatacatgtgccatgctggtgtgctgcacccattaacttgtcatttagcattagatatatatcctaatgctatccctcccccctccccccaccccacaacagtccccagagtgtgatgttccccttcctgtgtccatgtgttctcattgttcaattcccatctatgagtgagaacatggcggtgtttggttttttgtccttgtgatagtttactgagaataatgatttccaatttcatccatgtccctacaaaggacatgaactcatcatttttatgactgcatagtattccatggtgtatatatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggttgaactagtttacagtcccaccaacagtgtaaaagtgttcctatttctccacatcctctccagcacctgttttttcctgactttttttttctatttctagactctttattaagattcattttcctatgaaaaagtccattctttagtcagttctacactgtcttgattaaggtagctttataggaagtttttaaatcaggtaatgtaacccctccaaattcatcctcccttttcgaaattgtttggtcattctgaatcctttactttttaatataaatttaaaaattatcttgccaaataatcttgtttgaattttaattgggattgtgtggaatttatagatcaatttggggaagactgtcatctaaaaatattgaatcttcaattcattaacatgaatttattcccccatttatttttatttatttatttatttttctttattattattatactttaagttttagggtacatgtgcacaatgtgcaggttagttacatatgtattcatgtgccatgctggtgcgctgcaccgactaactcatcatctaccattagtttcctgactgtttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccattttttgatggggttgtttgtttttttcttgtaaatttgtttgagttcattgtagattctggatattagccctttgtcagatgagtaggtcgcgaaaattttctcccattttgtaggttgcctgttcactctgatgatagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatacaagggacgtgaaggacctcttcaaggagaactacaaaccactgctcaatgaaataaaagaggatacaaacaaatggaagaacattccatgcttatggataggaagaatcaatatcgtgaaaatggccatactgcccaaggtaatttatagattcaatgtcatccccatcaagctgccaatgactttcttcacagaattggaaaaaactactttaaagttcatatggaaccaaaaaggagcccgcattgccaagtcaatcctaagccaaaagaacaaagctggaggcatcatgcaacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctattgaataaatggtgctgggaaaactggctagccatatgtagaaagctgaaactggatcccttccttacaccttatacaaaaattaattcaagatggattaaagagtcgtagcatctttcaaaggtgactaatgattttaacattattactataaacctatagatttaaacataattgctatgttttaacccattatagttattattcctgttgatgatcaagctctatctttggccagtgggagcctctgcaaattgattagtgaatctttttgacatggaactattagtctttgacaaaatctttgatttctggtatgacaatatattccagttttatcttatatacttccagtcctatacataatattaactttttttcaaagaattactggttttatttttagtgggaaatggcatttaaaataaggaagttggcgaggcgcagtggctcacgcctgtaatcccagcactttgggaggccgaggcgcgcagatcacaaggtcaggagttcgagaccagcctggccaatatggtgaaaccccatctctactaaaaacaaacaaaattagccagacgtggtggcacacacctgtagtcccagctactcaggaggctgaagcagaaaaaaataaataaaataaggaagtctgcctatatgggttatctacctcttttttagggctcaacctacccgtttcacacaaacccaactgaattcggactctatatgtgctaggcaagtttgagctttttcaggtgtacacacagggtttactgaactctggcatataattatttatttattcattttatcaagttttgtcctatcattgaaactcattcttgaataaagttattatatttagttcagttacagcagacaccccattttgaaaacattatgtcaacattggcttgtgtaccttgtcacatcagtaatgtacagttctcatttaccagaaatttttatatgaacaacatattgaagttattaagttaatgaattctgccaaggtattggtatatatttgttcattataagcatttaaaaacaaaggaaccttttaaagttgaagataatttaatgggccattgcatgcaaagaggtgttgcattagtaaccaaccttaaactactgctgaaacaactttatgcttgagttagatatgttgatgggagccaataattgtgaaatttgtgtatccagactctcttctgctctgttcttaatggatctagtgttaatgttagaatctagtgcatttcacaactgttgctattatagatggaatatcaggaggggtagtgaggtattgagatagatgaaaacattttctaaaagtggctcacgcctgtaatcccagcactttgggaggctgaggtgggtggatcacctgaggtcaggagttcaagaccagcctgaccaacatggtgaaaccatgtctctactaaaaatacaaaaattagctgggggtggtgtcaggcacctgtaatcccagctaccagggaggctgaggcaggagaattgcttgaacccaggaggcagaggttgagttttctccacagctttggatcctgatgacttttttttttttaattgttactttcaacttccttgctttgactgaagccatacttacatattactgataacatatgccatgggccgcgcatggtggctcacgcctgtaatcccagcactttgggaggccgaggcgggtggatcacctgaggtcagcagttcagaccagcctggccaacatggcgaaaccccgtctctactaaaaatacaaaaattagctgggcttggtggtgggctcctgtaatcccagctactcgggaggctgagggaggagaatcgcttgaacctgggaggcagaggttgcctgtgcactcgggccactgccgtccagcctgggtgacagcgcaagacttcatctaaaaacaaacaaagaaaaacataatccatgtatgtgatgtaaagagcgccaacatgtttatatcctcctatttcaatctacttttacttcatctacatttttagcaataatgtgaacatgaaatcttgaataattagctatctgtaatatatttactcatccactcaaaatattgagcccccccaataaatatcatacactatattctaggtacaggtgataaacaattcagagagtattaatttcaaaacatggtaagtgcatagtgagagagctgatctggtctggtggttgagggaatcaagagatatttgagttgaggtctgcagtattatagaaaattaactaatcaaaagagaggcagtcattccaaggaaggggatgtgagtcagaagaaactgcatgtggcaagctctgaggtgggacaaagcaaggacatattgaaggaattgtgactggagcatagggatggaggaaaacattgtagctagctgagaaataagcatggaaaaatgttgtagagctgtataggccatgttaggacttttgtctttatcttaaggataagccattgatgtgtttataaagacacatgatgtgatcagattttcagttaaatttaaaaaatacttggaatgcattttggagaatggtttaggggagaggcaagagtggattctgtgggccagtagttcagaggataggttatggtagcttggactaaagtgcctgagccaagatggagagaagtagattgctttaagacatatttaaagaataacatcagcacttagcaatgaactggagatggaagatgagggaagggaaggtgttaggcaggtttttacaatgagagaggttggtgatcatggtcaccaaggtagggaatgctggatgaggatgcagtttaaggtgaagattatgagttcaggttcagcaaaactgaacttgagacatggtgaactatcaaggtggagatatccagtgaaagttagagagaggggtctagagctcagggaggagtgtgtatccctaatttagactaatttgcattaacagctgtagtaatgcaattttctctatactgaaatgcagacatttgagtatagaaaattagcagacatttgaatatagaagaaagatttactttccttcagaaaaagaatagtagagtataaagaataatatttaatcctaggaattaataccaaaccctttaaaaaaaacttttaagttcaggggtacatgtgcaggtttgttacataggttaaacttctgtcatgagggtttgttgtacagattgtttcatcacccaggtattaagtctagtacttgttagttagttatttttccttattttctccctccacccatcttccaccttctgataggccccggtgtgtgttgttcccctctgtgtgttcatgtgttctcatcatttatcttccacttataagtgagaacatgtggtatttggttttctgttcctgcattagtttgctaagcataatggcttccagctccatccatgtccctgcaaaaggacatgctattgttctttttttatggctgcatagtattccatggtgtatatgtaccacattttctttatccagtctatcactgatgggcatttatgttgattcaattttttttggctattgtgaatactattgcaataaacatacacatgcaagtgtcttcataatagaatgatttatattcctttgggtgtatacccagtaatgggattgctgggttgaatggtatttctgtctttaggtctttgaggaatcatcgcacagtcccccacaatggttgaaccaatttacactcccaccagcagagtctaagtgttcctttttctccactacctcaacagcatctgttattttttttgactttttaataatagccattctgacttgtgtgagatagtatctcattgtggttttgatttgcatttttctaatgatcagtgatgttgagcttttcttcatatgattgttagccacatgtatgtcttcttttgaacagtgtctgttcatgtcctttgcccattttttaataggggtgttttattcttgtaaatttgtttaaggtctttatagatgctggatattagacctttgtcagatgcatagtttaaagaaatgttctcccattctgtaggttgtctgtttactctgttgatagtttcttttaccgtgcagaagctttttagtttaattagattgcatttgtcaattttttcttttgatgcaattgctctgtgtcttcctcatgaaatctttgcctgtacctatgttctgaatggtactgcctagactgtcttccagggttttgatagttttgggttttacatttaagtctttactctatcttgagttaagttttgtatatggtgtaaggaaggggtccagatttaatcttctgcatatggctagccagttatcccagcaccatttattgaatagggaatctgttctccattgcttgtttttgtcaggtttgttgaagatcagatagttggaggtgtgtagtctcatttctgggttctctgttctgttccattagtctgtgtctgcttttttttatgttcttaacttttatttatttatttattcatgtattcatttatttttaccagtgccatgttgttttggttgctgtagccctgtagtatagtttgaagtcaggtaatgtgatgcctccagctttgttctttctgcttaggattggtttggaaaattagggcacttttttggttccatatgacttttaaaatagttttttctagttctatgaagagattcaatggtagtttcataggtatagcactgaatctataaattgctttggccagtatggccattttcacaatactgattcttcctatacatgagcatagaatgcttttccatttgtttatgttatctctgatttccttgagcagtagtttgtggttctccttgtagagatttttttttgtatcctgagactttgctgaagttgtttatcagcttaagaagcttttgggctgagacaatggggtcttctagatataagatcatgtcacctgcaaagaaagatagtttgacttcctctcttcttatttggatgcctttatttctttctcttccctgattgcccttgccagaatattcaatactatgttgaatagaagtgttgaatagaaactaatgctgcaagcattagtttcaaagaacttcttgatttctgccttaatttgattgtttacccaaaagtcattcaggagcaggcgtttcactttccgtgtaattgtatggttttgagtgaatttcttagtattcatctctaatttaattgtgctgtggtctgggagacagtttgttatgatttcagttcttttgcatttgctgaggagtgttttaattccaattatgtgatcaattttagagtatgtgccatgtggtaatgagaagaatgtagattctgttgtttttcactggagagttttgtatatatctatcaggttcatttgatccagtgttgagttcaggtcctgaatatcttggttaattttctgtctcggtgatctgtctaatattctcactggggtgttaaagtctcccactattattgtgtgggagtcagtctctttgaaggtctgtaagaacatgattatgaatctgggtgttcctgtgttgggtgtatatatatttaggatagttagattttctcgttgaattgaaccctttaccattatgtaatgcgtttctttgtcttttttgttcttgttggtttaaagtctgttttgtcagaaactaggattggaaccctgcttttttctgatttgcatttccttgatatatttttctccatccttttattttgagcctatctcattgcatgtaagatggatctcttgaagacagcataccgatgggtcttggctctttacttggcttgccgctctgtcttctaattggtgcatttagcctatttacatttaaggttatgatcctgtcatcataatgctagctggttgctttgcagacttgtttttgtggttgctttatagtgttactaatttgtgtacttcagtgtgtttttatagtgactggtaatggtctttcctttccacaattagtgcttccttcaggagctcttgtaaggcaggtctggtggtaactaattccttcagcatttgcttgtctgcaaaggatcttatttttccttctcttatgaaacttagtttgaccagatataaaattctgggttggagtttcttttctttaaaaacattgaatattggcctccaatcacttctggcttgtagggtttcagctgagaggtctgttgttagtctgatggggttccctttgtaacctgggctttctctctggctgcctttaacatttgttctttcattttgaccttagagaatatgatgattatgtgtcttggggatgaacttattatggggtatcttactggggttctctgcatttcctgaacttgaatgttggcctctctggctaggatggggaagttctcatggatgatattttaaaatatgctttccaagttggttccactatcttccatttttttcaggtaaaccaatgaattgtagatgtggtctctatataatcctatatttctaggaggttttgtttattcatttttattcttttttctctattcttgtctgcttgtctaattttggaaaggtagtcttcaagcttggaaattctctccttcacttagtctattctgttattaatacttgtgattgcattatgaaattttgggggttgggagtggtggctcacacctgtaattccagcactttgggaggctgaggtgggtggatcatttgaggtcaggagtttgagaccagcctggataatgtggtgaaaccccacctctactaaaaataccaaaaaaaaaaatcatagctgggcatgggggaacatgcttataatctcagctactggggagactgaggcaggagaattgcttgaacctgggagatgaaggttgcagtgagctgagatcgtgccactgcactccagcctgggtgagttgagagtccgtatcaaaagcaaacctacacatttttgtggcctgtttttagctctatcaagtcagttacattcttctgtattctagcttttttatctgtaagctcctgcaatgctttattagaatttttagttcctttgcattttgttacaacatactcctataactctgcgaacttcattcctatccatattctgaattctgcttctatcatttcagccatctcagcctcagcctggtactgaacgcttgccagagaggtgatgtggtcctttggaggaaagaaggtactcttgattattgagttttcagtgttcttgtgctgattatttcttatctttgtgggctcatctaccttcaatctttgaggttgctgacatttggattattttttcttttatcctatttgatgaccttgagggtttgattgtgttataaggtcaattcaaccaactagctttgtatctggaagactttagggggccatcgttcacctcccaactcctggactgcatgttctaactctggatgacttgtattgggccccaactttgttctctggttcctcgaggtttggagtctactttgttggaggaccaaggtgtggcagctccagctgggtgctagcggattcaggggtgcctgcctccctgcaggcattcaccatgctagtgaaggcaaggcatttttgtggggaacaggaggctcctgctatagactgtctgtgcttttgcactggtgatggtgttggtttggtgagaggcactgaccagtgcagatctgagtgccttcttggtcacctgcaagcaggagggattgctcagggtgtgggaggatcctctgttctccatgcagcattaccacaagagtgaggcactggcagctgcagggcttgctggctgtgtgctgctaaggttctgtctgcaatggtggttgacagaggtcaaggggcatacttccctcctgtatgctagtggggcaactaaagcaaattccacctgtgcagacatgtgcctgcaaagtgatgtggggagttgccatgggctcaggggaagttgcagtatgggtagcgaacacccggctggtgtgcgcagtaagggctgtcttgctggagttctccactggtcaggcatggcccactggtgcagaagctattctgtgggccaccacagcacccaagatggccctagaagaggccagcagaccaaggagtgctcaggttgcaccagccctgactgatgtacaagaccactctgcagatatcaagtctgaaaattcccctagggccaaagtctattatgggagcaagttgagcctagagggatcgccatccctgtccatgcactgctgtagacactcctgcactaaaccctctgggctccacatcagctggcttgctgctctaccactttgcttgtctcttgggggctccaccccagagagatgtgggtcagcaatcattcagttcaatcagcccaggatggagagtctgtgctatgggcccaagccaggggctctctgtctggtgacgagcagctggggggtggggtgggacctgtgggagatggactggcctcctctccttgagtcaactgctgcttattggaggtgtggatgagacacttagggtctttgctcctttattagtcagagggtagcaaggacagttccattgcagaggtagtggcagagaggctttcagttgtccgtggcggctctgtccagggagttgctgagttgctattggcttgatatctctggtggggtgtggctagaggtccaggcctggaggacctgctcgttgaagagatgtgggaatgggcacccacataacagtctgttcacttttccatagggctgctgtagtatgctgggggccagctccagtccctggtcactttagattttccagtacctggaggtgtcaccagtgaaagctgcgaaacagcaaagatggtggccttcctttctctctgggagctccatccctgggaaatacaggcctgttgctggcccgaacacactggtaggacatggctgaagacgctagttgggagacctcacccagccaggaggaataggatcagggacctgctttcaaaagtagtcttgccccattttcatagaggagttgtgccatactgggggtatgctttagcccctgattgcctcagacactctgaagcccaaaggctggaatggctaagttgttctaacagcaaatatggtgggctgctcctctccctgggacaaaggtcccatggaagtctgaaacctctctcagtcagagaacaccagttggggtagccggggaccccagatgggagactctacccagtgatgaggaacgggattggggacctgctaaaaaaaaaaaaaaagcagtgtggccacatttttgtcgggcagctgttctgtgctggggttccccttccacccctgcttaagctccccaaagcctgaaggctggaatgggtaagttgcccaaacagcaaagatggcagcctgcccctccctctgggagctctgtcccagggagttttcagatctctgtcagctggagaacactggcaggtgtggctggaggccccagttgggaggtcccgcctgtaaggatgaatgggatcggggaccaacttaaagcagcagtctggccacattttaatagagcaactgtgctgtgctgggggatctctttggcccctggttagtttggactctccaaagcccaaaggccataatggctaagttgcccaaacagcagagatgggggcctgcccctcctcctgggagctttgtaccagggaggcacaatgttgctactggtggctagctggaattccaagccagtgggtcttatcctgtgaggcgctgtggaagtggggcctgtagaccttctctgctgatctcgctggattcagcctcttttctggggtatgtatgggagtctaacctcctggggtatgtttgggggtctaacctccagctttgccaaagtcgcagctacttttgcccagacacccagaaagctggagtagctaaagctcttgggtctccatgcatgcctgagtggctgctctgctgagactccacgtggctgtgtgtgaagggcctaatggagtgagttcacaaggggatctcctgatctgaggtttgcaaagatctgtgagagcagtgtggattcccagagttgcgcattcacttaccacttccctgggaaggggagtttcccttgactccacgtctttcccaagtgggctgtcttcctgccttgatttgctctggtctccgtgggtcgagttgtttccttgattacttccaatgagagtaccttaatgtttcagttgaaggtgctatatttagtcacccctttctttccgccctgtgagagtcacacacattaactgcttctagttggccatcttggccactcctgccctaaacctttctagcaaaaaaaaaaaaaaaattaataacatgttgatctaccgcttctctctctttaaatttatttaatcattatgaatttttttacatttatttacattgttaagctgttttattttaaaaattctaggtccagctcttcctggattgcttttatataaggaacatatctcatgaaataaataaaattcacattcaaatgcagaagaatctattggaaaaaactcagaggacaggataaaagcactcagaaaaaatgccaggagaaggcgtttatcacataatatcgctgataagagtctctcgaaaatttttctctctattcattcttaccaaatatagaaagtgaacaaaacaatattagtattagaaaaaacatccaaaaataatgacctttctgaatgaagactgcttttttcatggttactctttttggggtacagttctatgttgatttatccaatttatcaaatagccattcagcaaatatttattgagtgtctgttatgtcacaggcactcttttcggtcctcaaaatacatccgtgacaaagagtaaaagattcctgttcatggctcttacattccaggagggatagcaatttcttttgtaaagttaatcacacaacagaaatgtgaaataatattgatgctgtaaggaaaggaaaaataaatgaaataaattgaaaaagaaatgtgaaggaataattaaaagaggctatattttattgaataaaaataaaagaggctatgttttattgaatatgctccatgttttatactatatcataaaacatacaagatctggcttttaagaaatcaatatcttcatcaatatcttcattcagactcatctagattagattactctgaatctaatcacatagagacttgtctgacaaatccagattttttggacgttctgcaggactatttgtcaggatatttcacaggattccaagaaataatattggtgtccatgctataatgattcctcagctcctcccatctgataaaatattgatttcttatacatataaaacatataaaaatatttaaaatattttttgttatatgagtgaatcaataataaaaccactatctcaataatcatcaactgattgcaaactgattgttcatctcagaaaaaccttggcagagttaaaataaaagtttcaaaatacagaacttagtaccaaaattaaggcagtgttaggtttctaattttgctattcacatgttaaatgaattttcaaaattcagtagctaatactagctagggttttaaacaagacatagttaaaatgaaactttaaaaaaagaatcataaacttcagtatcatcatgatggcagttttaggattttaatgttgacaccctagtctcaaatttgtacttaatgtggttatatagctaggcagtgctggagtgaaagtttcaaaacaaattaaaatcaaaagttaagaaaaaaatatgaaggcaattttaaggtgtttaatttggcactgtagtttcaaaatagtacctgaaacttaacagcaaagtatcagattcatttataaaacaatgtgactgatctttatgtatggtttgtgaaacatttatgcagtgtcacttcagaaaactctgccattatagatttgaattgattaaggatatccactcctttccttggcatgatacaaataaattactaaagtataattgtaacaatgataaatataagtgacaataccaccatattactatgaaacacagattgattatggtataatacaatttagcatctccatatttttgaaaatgaacttgtttctctaactggcttaatttgggacaatttggacatcaaaaagaatgatgatgcaatttaaaccatacaaaaattaaaaaaaaaaatccaagggacggtggtgaaagtcttctttctagaagaatagcagctaatatacacagaacgaatcttagaattagaaaatcactatattttgatccccttccccaaagggtgacaaaaccattggtagacagtggttgagaaacagaatagtctcaggatatcactccgtagatttattcattaattaaaaagagaaaatgtgctttgagagagagaaagctattaccgtctttatcaaataggagagcctgatcatgtgtggtctgaagtttatctaatgggattcctgatggaatgtttagtctgaatctaatcacatagagacttgtctgacaaatccagattttttggatgttttgcaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgtaagtgctgtttgggaaaccatcatctttcaggtctgtgtgataaaagaagagccttggggaaatgttctcttccaaatttaatctttacattattagaaaatattttgatgacctgttttcaaatattttcttataactttccattttcatgtgtttattctgacagtttattttatcttgtatttataatcactaagatgttagtattgtaatattaatattacatgatttaaattaggaaaaatgtgttttctattacaaaatggatagtggataatttaagtatagaaagtaatattttctatatgggactatttcactctctgtaatatcctgaattctaattcccactgtagtgagctataactttactaatcagttttcttacaatcgattttaagtctattttgttagatctaaagacataaagccaaaagttcttcttgaagagaagcacatttcagttacgtttataacttgaaatatctggttttactcaaaactcacatgtcatactgaaaaacagaagggagatgttgtcttttcttgaggagagacttctctgcagttaaacagctcaccacatgtttagagtacatagacaatacacttcctcttttgtaatgtagatttcagctttttgcttgtagaattatcattggcgtggaggttatacaggggaagtagtgaaaaatgtagccaataccaggaaccttaggaagtgtctgaacttcatcttttctgtgttcctttgcccttagggggtcagtgtaagagtttgggctaggaagagattgcttcttttactctatttagtttgtacttcctatctgggtatttgacaataaatgactcattctctttgtttgccctggtgttgaaaaattttcccatatgccagagaaaaaatgttacagtgacacaatgtaaaattgtaagaggtggaaaaagatgaggtatggacatagtgaatggaagttcagccctttaaaactactggcagagtagattttactcaggcttcaattaagtagacctgaatgtaaattcaggtctagctctgcaacttactaggtaagtgactttagtcctctttaagatttagtttcctcattacaggatataataatactatttttcttatgaggtaagtattaattgaaatagtatatgtacattctagcatacagtgatcccctaataaatggaacttatcattaatacattgctaggaaaagaaaaacacatcagggaacaaaagatataactgtcttattgataacaggggatggattcttgtggacaaaaaaatttagaattgaattttcaaggggtcatttctttcaccaggtgtagttaggtttgctcttatggtaacaatgaatatgtttgtttagcttcttaaaccggcatcatggaacgttaattaataaacagaattcaatgtatttgtggggcattttattttttatgcaatcatttgtatatgtcaccttcacaatgcatgccacattctcagaccacctattatgttattttcttaacatttttcttcaaattcactcacccttttaaaaactttactgaagtctcacttaagcacataatttgtaaaatcatgggtttgttgtgcaagttttgtttttctaatacactctaaaacaaataccttaaaagagttacacctacagtccatataccacccataatcatctcaagtacctccagtgcttgttactgcactttggaaaacactaacatacattattctcattagtttttataatagttatatgaggtgaatagagaaggcataactatacccattttaaagatgagaaaagcaggttcatggataaaatctcatagtaaattgctagaattggtcctgatactcatgctttctttagatcaacccagtgctcttactgtaattgataccaaattctttaaggaaacttagagctaaaagtaaaattttttgtatttagacctgattattttgtggtaatttgaatataggtcaatatgaaaaaaaataaaagatgaaacaaagaaactgagagcagatcaccaagttgcggtaggttagcctaagatagcttttggttttctcagccttctactattcacagctttgtgtaatcccctccacttgagtatcttgctcataccaatagaatatggtagtagagtagaggtcacctctctgataagtttacagaagattgcgacctccgtcttgccagagtacttcctctcttgctggttttgatgaagcaggctgccacagaagagaggctcacatggcagggacctgagggcagcctctggccaacagcaagcagtaaacagatgccctcagttcaatatccctcaaagaaatgaatcttaccaacagccagttgtgttagctgggaagcaaatctttccctaagggagatttcagatgaggcccccagccttggtagacaccttgattgcagtcttgtgagagattgtgaagcagagctattctcagaattcatgggtgttttaagctatgaggttttttttggggggagaatggtcatttgtgattcagctatacataagtctacaaaagtcattccagaagtgattcagtggaggtagaatcatgtggttgtgagccccaggcacttggagttctgatagaattgtgacttctaacactggacaccttttctttttctcttattctcccatttttctcctttccccttttcctcccttccttcccttcattccttctactttttccgtactttaaattaatagagcagttggaaacacaaaagcaatgtctgtatctacaaaatgtcattatttatactttgtatccacagtgtgctgcctagggcttcatgcctgaggtgcatctgtagaaggtgctcaacaaaggcttggctgttggtattattgaatcactgtggagtttattcattgttgtccatgccattttgagttttcatttttttatttatgggagtgtctttattcttttaaagagctttgtttgtacactcattttctctctctctcttttcttccacaggcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcaggtgagcaagcattactgcttgagttccgcctcctgtcagatcagcagtggcattagattctcataggagcacaaaccctattgtgaactgcacacgcaagggatctaggttgtgcgccctttatgagaatctaactaatggctgatgatctgacgtggaacagtttcaacccagagcaccccccacccacctgcagaagaattgacttttacgaaaccagtccctggtgccaaaaaggttggggaccaccgctgcactacactacctaaaagattttcactttcacagtgttgcttgcttctgttttacatgcacaagtagctaaagctagccttctggtaaatggaggggcagagcagatggtgggggaggagtacatacggacgaatttgaatcacaatttcctcactatatgccagcaaaatttaataatagcacctaaacatacacatgcatatgtaaatgagtcacactataaaaacttttaacaagtactggcaagtcagatggcagacttaccctgaaacctgccactccaataaaaacctcataattaaaaacaaggctgtctataaagcataacatataataacaattatttgcaactggtacaaggctagattagaaagttgaaagttatctttctcaggtaaaaatgcttttcctatacagtatgcagccagcagattatcatccatagtttgagtagtgagatgccacttgctccaacaattaacacctgctgatgttggtccaagaagagactgaggtgatgcagtttcacctgttttgtaagaataacgctggtgtttgccatctattgacagagtgcctactacgtgccagatgctttgttggcactgaatgtgctatctcattccagtttctttatactcaatgaaaaaccaactacatttatattgcattgaggcttaaagtggtttactgacttgcttaagattatacaagtagtaggtggctacagcagggtttgaacccaagtatgcttgattccccaaaccatgctttttaaaaaatcaaaggtgtaacttcgataaaagacatgaagttaatgaatatatgaaagatggtgaatagatacagatacaatgtggccttaggccagatcatgttgaacatgtggtgggatagataagagaaggttcttctttgttgttacctggttctcaattggttattactttatgtgctttccatattaaaattctattattctggtctataaattcacccacccagacttgcctaaactaattaaaccctgaagtttggcatgtctcttttttggggtgcctctatgataggtggtagaaatgaaaatggaattaaaagttttgtgaagctatagcactactttttcattgtgttcccccctgactttctgccttaggtgtttactttggtgagatatcctgggagaaattgaggtgaaaagaagcccgagttaggattagggaagagatgaagtagtcaataaaattcaaattcttgtattctgaaacgcaactattctttctccaacttggttttggacagaatgtcttagtgtagctgttaacaaagaaattgatgacaattaactcccatttctcagaatttcatcattctttgaaagtgtttatcatactcaatcttctaaaaatccttaaggcatactacagtgtagaggttggcaaactttttctatagaggtcctgatagtagcttgtttcgcttttgagggccatcgagtttctgtcacaactactcatctctgctgttgtaataaagactcacccatagacaatacatgaatgaaggagtatctatgttccaataagacttttaaaaataaaattaggcagcaagactgatttgacataagggtcataatttgctaacctgtggtatagtgaaaggagttcaactagagtttgattatggctgtgccattctagttgggtagttttaggaaagttatttaatttagatttgatgtagttttctcatatgtaaaatggggataataaaacctgcttcacaagactactatgaggagtaagctatgtagctaaatatagcaaaatatctggcatctaatagatgcctaataaatggtgactataatgattcttatcattactgtattattttaaacatttatcttttttttttaggttgttgtctaactaaggtatttagagaaaataagtgctgctgagggcagctggaactgttttgctggttcatcactgaaattctagttcttgttggtgcttatttcataattatgaaactaattcttttgaaaagaacttgaagtagagcaacaagaactaagatagaactaataccattctctctcagttcttattgctttacttcaagttcttttgaaaagaattacatagatatgggtgcatgtgtttgtttattttccttgttgggtaatcgtgaatatgttgattggcgtcaaacatgggtctcacctatacccatggcagtaagcttctattgatttgaattcagactagccctggtggccctgtgagtgggaaagtctaggtgtgcctagcttggtctgtggttccacgaggggttggatgcatctgttctacttgtggaatgttggcaccaatatattggctgcttctccgagtatttgcctttgtcttctttgtgaaaggtcactggctggtttgagctattgggctgtttatgccacatcctgtgcatgccacactggctttctttctgtggtgtttccagagataagtttgcctgatagaagtcagactctgtggctttttatcattatagatttttctagaaggagaagaggccatgatcacatctgaggatcctgagtcattgtagacatgtactgaattaaagagaattttttgactaaaggagaattgcatcaatcacggtgaaggagatgccacaggacagggcctgaggtgttggcttagccacagatgtaagggctacagttaacagacaactttcagtttccactattggaagggatgatcagtccttccctcctctattttcttgagccccgtttttcacctttctttttctctctcctttcttatcatgaagaataaagacaaatgagaacagatctaccttaggctgatacagggcagggaatccatttaataataaaacgtgggtcaaaattcacttttctccttttgaattgaaattatattgtgcatgggctaattagattgaatgctgtaaacatgaagataatgcttgcaaagtagctacagagaaagagaaaaagcctaaaacaaccagtagtgcttaggaccaatagtataagtctttacacactacatttgaataatactgtaagacacaattctttgataggttaaatagcaaatctaggccccccaaaattatttaaaaaattgtcattttaattctagaggtataacaacagtgtgtaagttgcatcaaataacaaagttagtctacagcctaaattgtttcgtcctgcttttttcacttctatgcatatttttatacttccatgctagagctacctcattcttttaaaattgtgagatattctataatttatttgtattcccctattaatatatttttagcttattagtttacttaaaaagatttatgtttgccttctaatgtcaaagttaggagtcatctgtccatttaacaggtggtgttttcttgtgtaactcctctgccttcatgcaaacctttgagaacaatctcttgaaacaaggctaaaatgcctttggagaggtattatagatgatcatatctactttgtgcctctttccattacttagctgcattagaggcccagctgtgtaggtgtaactcaaaatccaccaaaactaatactgtggttagattctggtcaaacaagttgccattaatccagatgtagaatgggattgaaaggtggctcttccacaccctgacatcaatgtaccagtttggctctgtgcattctttctccccttctccctttaccaccctcatataattgtttgtgtacatgtctggtttcgtcactacgctgatggcaaggatcatgcatgccttattcatatttgtgttattcaaggattctactctgggttctattatggggcctggcctaaagtggttgttcaagaaatgtgtgttagagaaatcatacataaactagcaattctcatttggattcctgtatctgaacaactaactttcagcttcttcagtgggataaagaagaaaaatggggtttaaagtacatactattcagtattaatgtagaatttaacagctgccatccaagtgcagaatcctctgtagtttcccagtgttaacctcacttctatctctagccatgtctcagtgctgggtgactctctcctggcatgttctggcaagactctacctggtttgcgtaatctacatcggcttctagtttccacaagaattgtttatatgcatttaattttagctcttgggctataacatgtcattgttctttttacttatctcctcttacttctggaaacagggcaggcatcttcaatacttgctgttcctgtttggtgtgctcttagattaattttaactttcctcttcagctttcatgacacttcaagacattttccagtcatatttcctgtataagaaaatacagactatgtcaccacaaagggtagtggagattggggggcataatttaattcattcagggaactcatattttggtgtgaatggaaattaaagcaaggtatttggattaatttacctcatttggttctatattccatttagaggataacacattaagcttttattcaattttatctgttatggtcacagtgaatctggaaaaaaatatatatggggcttagttttcatatttaggggaaaatgaatatcctagagaataataataaaagttagggaaaataatgttttcctaagagtaggcaatgaaaatctgaaggtactcaaagcagtcttgcacaagtgctttgaaaagcctcttgcacaattttatttctttatagtacttacacaatcatatttcataatgacttgctataaacaatgttcttgacaagaagcttaaagatacaaaactgaaggaagcacttttgggagaaaatacttttatatttgcttacttctacactacaacagacataaaattatggatttttttttcagtgcaattttcatatgtcagttctaggagacaggaaatgtgaaacactgtaggaggtatgagtttgccacctagaggagagaggtgaaattcaacttttctccaatttctttagtataattcattaatttatttaattatttactcgtttaattattcaaaaataattatctaccaagcttaactattttgccagcgcagatttgataaatctgttcaagatttatgagctcaaagaaaccacaaagtgcatcttactttaattgctcagctgcctcttttaaaaatcttttacttttaagagagtatagcacaaatatctgaacaactctaaatatccatacttgggatggatattactttgagctcttgcactataataaaactttattcttttgtactaattcagtccttttactttttcttttttaatgtttaagaaacaagttggatatggacaagatgtaatttcttctgtcaaggaacccacaggataataggttaatgatagagaccaacaatgctgatgcatttttaatgacggagataatgtctagaaaaaaatccattatttggtaaagacaaagtatgcatatgtattcctttgtttcaattatttttaaagttaaaaaacaactgcttatctccttttgtactacaagcaatatctggtatagtgtatgcatagtaagtattctagaaatagtaatttcattgttgacttgattatattggagtggaacttactctggaagagatcctaactttcatttatctgagaaaatttccagttaggacatggaaattttttccttgtcaatatttattcttaatgtgtttagaattttagaaaatgggtttagggatttagaaatttctttactaaataactctagggaacagtaccttaaaaatattcaaaatgacaaaaacttaaaatgacatctaattttttaaggccaagaatcattaaaaagggatccaaatctttagactttgttgctcggtggaactagaatcattaatatctcagtcaggggaagccatgtcaacttactggtttaatttcctgtgagcttcccatgttctctccctgcaaggaccacctcaaatccctcagtagtcctgtctttatgaaaccagtataatttttcttttcgctcttgtccttcaccttcctgtggcaacaagagtcaattctccatatataaatactcggcccctgttttagctgtgtcttaattgcgcaacatctgtttactctgtgttttaacatctgtgtggatagcattgttgttgtaatattttgactgtaagcttctaggaggtagaggccagcattattttctccatttttggaatgagaaaatacagattaccacaatcaaagtagaatggcagcttatagtagttatttggataatttatatagtctcttaaaaaaacagattatagtaagaagtggctgagcaattagctatggcacactgcacggtttttctgacctctcagctcctaaataaactttgccaaatcttcaggccctcaaaattttttcattccatttgttatgggctgaattgtgttcccccgaaatgactatgctgaagtcctaactcctagtgcttcagaatgtgaccttatttggaaacagggtcattgcaaatataattagttaagatgcgatcttactgacataggagaagctcctaatcatggtgtccttataaaaaggagaattttggccatagagacatgcactgggagaatgctctctgaagactggagttatgctgctaaaagtcacaaaattaacagaagctacggaagagaccttgaataaattcttccctgtagccttgagggagaggatggcccagccaactgctaatctcagacgtctagcttccagagctgtgagacaatttctctttttaggccactcagtttgtggcactttgtacagcagtcctagccgactaacacaccactctaactgttgatcaaggcaagagcctgtgatcatgtattatcttgcttattccttatcagcattctatggtgtagatattagtgccatctatatacaaattaggaaatggagcctcatagaaattaaatgacaagttcaaggtgtcatggctatttcattatagtgccagtgtttgaacacaaatcaatttgactccaaaacatcattactctactcaattctagttcaatccagatgttcacaaacaaccagactatagtggagatgtgggtggtgggttgagaaggagatcataaccaacatcagactgtcagtgaagcagactgggagaagttttatgaagccaagcagctgtgcaaggtacagtagagatggtcagattgttcatgtgtatggattccatcttctgaggaatgaactccttgatattcctgagttagtccagtttaggcaggagtaaacagaaggtaaacagaagattggagactgtgtgtgtgcacgaatgcctcctttgtagctggatgtctaacatcatgatagccacactcacatgaatacagagatacacaatttacaaattaatgtaacataaaactcccatgcagtctgatttcatcttactgacatttctgtcagtcagtgttagcatcttaattatataaatgtggaaactgaaatactcaagaggttccctgacttcccaggccacacagtaagctttggtgccagaatgtatctctaggctttctcatctcaacccagcattcattatactattgctcactgcgtgtagaatcagatttgatttctctgacttttcttagtcacttctgtggttttgtaccactccctctctcactaaataactgcctgcaaaagtaaaaatttccatgaaaacagaaaacaaatgtaccagaaatgttgatggtgtaagagataaaactgggataaagagaaaatgtgttggaaagtggtgtcctttaatgcaacagaaaagtatattgggagaaaaagaaaagagagaaaaatagacaatctgaagtgatgagaagagcaaatgctacagatgtacctgaacctcttcagtaggtgtgatcctgaagagttgtgtataacaacaatgaacaaaaataaaatgtactgtggaaattgtctagctgttgagatcctcctgtgcgatatttttcaaagtgaaaactccaatcaaccctagcttatttatggagaagactttgccccacagtacccagaaagtttcttgacaatatcatatatgcataataaccctgagacaatttttgtttaccaggaaaacatataaaagggaacattaaactttgtctagttctactgcataaacatgtgataatgtgcatggtgaccttctgttgtaaatggaaagagttaagctctctgaatctactgctgaaaggtgaaaacactttcttagggctttgaacttcatttgaaatcttactgaaaaaacactacagactctattttctttatatttgaagatactttacataaaaatctaaagcattttgacttatgttttcatctacttgagaaggaaactcacagactccaaagcaactgttgtctgttttgaaaaaaatttcagaaatcaccagaagcaatagggagtggccttgattcctgttcttgtatttatgggtagctaaagttcatatttctcaacataccataatctctgtgtaattggccaaattccatggtggataattagatctagcttaccagggcagatttggatggtgagagcagtcacactgttctgggaatatgttagccaagtttactatgttttacatgagttgacagactcacctcacttgctgaaggactagcccagcaggttctacgggtgagatcactgctagctcattcactgctgggcctggtaggcacaagaggccaagaaataaataatgtgaatttgggcttcagaagttctctttcctattttctttcctaaaccctttcttctaccagctgtctaggggctaaaacatttgttcatacgtttattaactaattcaacaaatatttaccaaccatgtttcaggcactggacactagaaatataatagtgaactagacattttctgccttcaagggtctatgaacaattataatattctgaaaaatattacaattcacagagctcagtaatccaaatccttattatttctgtctttaaaaagcagaaagtgaaaaatgctcttaaaagaggatggcatagaaatgtatttatgcattgcaacagataaaattaaggaatgcatgaagactggttcatctgtgtggttgtgagtcaagaataaatcccaccctccctgaagtactcagactctaccttgccccatggccaccactgtggcccaatggaagcaccagtccagggggtctccattcatgctgtctttggatgtcttcagaatgttgtttcacaagtactcagacccaacagtaagattttaaaaattgtccataatattaaccttggcattattatgttaaagaaagcaaaacagatatcactgagtttacttctcaaaaaaaccttgcgttcctgcaaaagtttcttgaattctgactcttgtcacacaatcacacaagaatggctatacttaaacccttctaatcaattatatccttaatatgtatgactgagtgatgtgttttcatgactatgaaatgtatacatgtttggaaaatctattcacaatagagttttatgatattcctgttaacaggctgtcattgtaacactgtttatgcaggaattgtaattctatctgtttttatttttagcgtcttttctctccatcccccaaattttaaggagctatcaggtctgtattttatttggttttgaagttttaggttatttgtagttataatagccatatcaattattcatttagcaaacatgtattgagtgctactatgtgcttagatttttccaatgttgtgaaggataattggctaaaacttttccacttttattagtaatttgagagtttttttctccatggattttagtcactggtaaaggctgtttcatattcatagatttttttctacggtaagaaacatatgatgttgaataaggtatgaattacaaattaaggcttttccacattcgctgcctttataagatttttttttcttcatcaaaatctattcacacacacacagacacacatgcgctgttttgattttcttcaaatatatccagtgttcagttcttgggcacatattaatatacttgcctagatgaagactatgtgtcctcaggaatttataatctagcaggtgaaagatttgcttctttcaaaatgtgactctacttccccactccttaggttgtgaaagcagttgtttacgctttatttcattgttttccaaactttagttatttatgtgccatcttcatgattatgctattcacataccacctatactattatgcttctgaaaatatactatgattttcaacttaattaaatttgtttagtaataacagtagctgttacatcactaggttgatgtgctagttaaaaatttttaaatatactttaatataaatatgttactactaaattatttttttgtctgtatgcacccaaaatcttgcctttagtagtactacacatatcatgctttgggaaactctacccatgagattcatattcaagcatgaggaatggcaaaagaaaatacagaaatagtgatagtaaccatagcaatggtaataagagctattatttattgaggactttacgtatgtcatttaattttattttatcctcacaacaaattttagccatgagtatcagataaatatgaggcaaaagggcaggaaagaaggaacagtggaagtcaagctttttttcgcctaggtcagctataactaacacgacaagatgttttagtatttgtactttatttttagtcagctcagatttcacacctgactattttacaaaaatttggatgtgatggtggcagattaacataattacttttagcaattattatgggacaaattagttaaaggttgtaaaatgcctagaaacagagtagaatatcctagtaggatatcctagaatatcctataattaagttatcaaacaattactctgattatttttcacagtagttcaatcaaagtgtaactttgggtctgttagtatacatgagtgtgaatactctggagatttgatctttggctttcctgtgtaagttcatatatatttttgttattatcctgtaaataactgaattatagtacagtgattctgtaaaaaacactttagttattaatattctttggtgtgaagttcacattaaaaattgttatatttccagaacctggtttttacctgtgaaagtcaatgcatccttcttttaatcctctgcattggttttgcatagcttgatgaaatatgacttgcttctcctccctccccctccttcctgtgcctgtatccccatcatttttttttctattcctcttggtatctggacttctttttctgccaaatgagtcagtaagagaggaaatgtttaacccacatttgtcatcttggctgggaaagaagtttgaaggcaaaaggtgcctgaatatgtttcactaggatgctgacacaacctttttgactctctcctaagaatactactctatattcaagttataaagtgctaaatgatctatttccaccatgtatacatttcatatgatcaatacttattttgtaacttttttctttgaggagaagtatttttcttttggaaaaatattatttatttgtgtgtgtgtgtgtgtgtgtgtgtgtgtgtgtatttattttcttttaatatgtggtctccctatgcaaaggatttgattttataaacagaagcaataggattaagaggataaaggaaaaataggagaaggggaaatatgagtatcatgataaggtaaaaatgaattgcttgtattctaacatagaatagctactacctgttgagtgtttattatatattagacatttaagactaatcaaaatatctaatctaatgaaataatcactgttttgaatttgcttagatttagtagatgtagaaactgagacttagagaggtttatttactcaactccacactgctaattactggtgaaagtagaattttactcctctggttttctcatccagcacatcatcactataacccttatagtttgcttttggcacaagtattcattattaatggaaatgcatagtattatctcagcaaatgtacaaatagtttagcttcactaaactagtcaattttttttttctaaacatcaatgcttaggaagcaaaacaggctgggggaacagtagttgtactggtggcagctgtggtgctgatggaggaagtggtggaatgcataggctgctcatgctttttgccacaatgaaggtcaaaaagtagatcacttaaagtctaaagttaaccttgggggtcatattcttcaccaaaaactatgtttatacatatagacttagcagtatgctataaaagtgaagatatagcactataaaattccaccataaagtaaattgttcaagattgtggtccaagctcttcaaaatgctcataaatcagaaggtgtatttattaaacaatattttatatgtacctataataatacaatactatactacacaaattggacctaaaatgaattctcttgctatattaaatattaaacattaaataggcagaaattttgtttgcactggacttagaatataagaagaaaatttgggacaacctgaatagttgaggtctcttgagaaacccttcagcttcttttcctccaaataaatttctctgtagcaaatggaagccatccaaatgattccctagctacctcaaagtactgtaatttgtctacttcacaaagtggaggactatatctagcaataattcaagaaaaatgcagtgactcccattatatcttaggcactatgctaggaagtttatgcatatcattttgtttgattttaatagcaacttcatgaaataaatcatcataataaatcactatttcagatattgagaaaccacagaaagagagaagttaaataattttcctgtcaaagaccacatcaatgatgaagccagaatttgagctcatgtacttaaccactggactacctgcctgccctgtcgaggaacagctaaggttgtcatagagtcttgactgtgtatagatagttgtttgaagagagaaaaaaggcaggaggatctggggcatatgtttaaatcaggcattggcatctgtactagaattgaaaggtggaactattattgtgttctatttattgagtataggtataccatattcaatgtatttctctgcttcatacactatccaaggtgataaaagtgtttatgaagagggattaggaaatatctgctgtgtttaggtcatagtccaaccaaaggattaattaacatttgcctcttttttctcctacatccagtgtcccttttgatgagaagaataagcctcattctgattcaacagcagagatcaaagaaaagacttctgttttctggccaccagatatatgttatctgtgcttaaagaattgaaaaacacacatcaaaggagaattttcttggaaagagaggtaatgagatacagtgaaagagaatggagattctttaaatcacagagacctaggatcaaatcctgtgattagcactttttagtaatgtagcctacttcatttctttgagccctcgtttatttttctgaaaatgagggtgatctaaattacgtctggagtagtaataaagattaaatccatgtgatacaggtaaactcatgacaataatagacatgaaacaaatagtctttcatctccctcctttgctcaagcattgctctgctcttctcacctcctttcccttcctttttcttttctcctctttattttgtctgtacccaatagcttttcccaagccttaaaactatgtataggtatattgttgcagcaaaatgcataaaggagacactcattatttgcatccatttatatgctgatataaatatttcatcctcacaagtttcagagggaaagaccacatgctggtgatttggtgagaaagaagcaactatttctgtgatttaatttcaacctgagcattaaagaggcaccctttcactactagtggtaactccatgcttccaagaactaatgagctgaagaacttagcacttgtgatgaattagtcaagcaaaaattatgaagcgagtaatctataacattatagtacattacaaatgctgaaatatattagttattatttattatgattcttatagctcatttatactgtacaaaattcttctgtcattttatgaagatgttacacatatacataacaaaacttagctaattagatacaaagactatagaaccaaataactcttttctaaatattttccctttaaggaggttttgcaatccagctttgctgtggttagacactgttgatgagaaaactttttttttctttcttttttttttttagacagggaatcattctgttgcccaggctgtaatgcagtggcacaatcatggttcattgcagcctcaacctcttgggctatagtcgtcctcctgcctcagtcttctgagtagctgggactatttgatgtgcactcccatgtgcggctaatttttgtatttttttttttttgtagagatgggttttcaacatgttgcctaggctggtctcgagctcctaggctcaaggtatccacctgcctcagcctctcaaagtgctgggattacaggcgtgagtcagtgcgcctgacctggatgagaaaatattgagttggaaacccaaaatatgacataaataattggtatattttagagctggatttcaacaacttttcaacactgtcatcctgtaaatgtctttccgtcctaatcccattgcccatgcactcagcagaagtgtgtgcctctaaggtggatgctggtatgaaatatctcagctggggcaggctctgaaagggagagatctggttaaagtgctcataccaaacaaagctcctcatgatgctggcctaactctcccaatcctgcatttctcaacaaaactttttgctcttctctttcacataactcccgtggaataatttccattgaattgcatggaagaggctgttcatggggttagtctggcagataagaggtctccactggattttttcattttgcaatcagtttcatacatatacgtacatacttttcttggagtcatagttcattctcaggtcttttagagttaaatatctttcatttcttcttttaaggtcttaatttcttgtttttcgagtttcatgggagatatccagtcaccaatccaatccatatcggggaaaagtacaacaaatgagtgaaatttgtaaccaaccttggatgatggaataagacatttgggagaacacaggagaagtggggaggttaaggagggatagctctgtgaaaattttgcattactcttgcctgaggtctactcttccttgtcatgttggtggctgttttgacaatgagaaatatttaatggcaaacttagtcttctaatttgaaaatggaaatcataacagttcttgcctcttagggatagtgtgagacaagtgaaataatccatgtaagaggtatagtactatgcttgccattctttaagagctcaacaaatattcactttttacctattagtatcaatcttaattctaaaattctattatttaatattttccagtggtgtttctaaataatatctaatgactaggctaatacactatgtggttcttctagggttcaagcatcactgttaggtgtgctggaatcctttcccgagtcagtactgctttctagaagaaaaccggggagatctatttggaatgtatctaactccaaagaaaccatcagaggtaacaggtaggagatatgaaacgaccttttagatatgaaccctaattgaataaaagttgccaaacaactgttcccaaacatctaaagaagagttttagtctaagtggaatggctggagagtatgggaagagttctttcctactctgtccaaacacaagcctctgtgacatttatcaaagaaatgcagccctttaaatctgggtataagtccgaaaggtgctttccttgtgaagcttcttttgtcctctgcttttaggactctctgcacactgcatcctctatgtcaccctccagtacatctgctcttacacaaggggccccacagggactggcccacacaccagccagggcacatgggccaacttttaacagcaaaaggaaatgctaaatcctagagtagggcagatgagaaaaatggcattcttcagagagctgggatgactcacattaagatcaagggccctgaagtaagacagacctgagtctgaatctcaattccaacaataaatttgtttatacacttaaggcatcatgtatagtattgttaaatagatactttacaagattgtaactaagaggaagcaaaataatatctgtaaagcgtttcatagattggccagcatatagtaaacatttaataattagtagctattattatttttccttaaatattttttttctggcttcctagcaatcataaaatttagtcttgtatagactccatggctaggacttgcagaattaaaaatggtctgaacaatttagacattgcctttttgtcctcaaaccaaggggtgaatttttattctaaaatatccagattgtccatatcacttaaccagttgattgctaagtctgtatttctcttttatgcaattgggaaacattaaaaagttgaatgtatatactgtacacatacatgcacacacatagacttaagtacataaatgtgtatgtaccttccatagcacttagctcatctgttctttcctatgaccttttctataatcctgtgaagtaggttttatattatcctattttatgattaaaggagaagggaagacagaaaagcagcctggcttggccagaggccttgcaattgattacgtatagagccagggagtcctgaccccttttcagtttttcttcctctgtactgctgtgatgactgtggaagtgaagtacttctttggctgccaaggaagtcccagctgaaaggtaaccaaaggaaaggagtatttgggagcagcatggctgaaatccagttaacagttaaaatcccgttgggcaatttctcgttaattgacaacaggaattgctgtcactgtcctgtctagccactttcaaacggtggggatgttagcaagagctcccagtgaatgcttcctaggagagcagtgattgctttggctagcttcttctgtagcagttttctggcggtgaaaagtctgtactaagacaattggaggtggtaatcattttctaataaccacctcaggcttttggcacctaattcgctggcactgtctagggaagctccttatgctaactcatgcttcttgccatgtcaatctgcttatctaattttgctgggaaatctgatatcacccttcaaatagttcacctcagtgggatccagtgtgtgacctgcaaagtgctcaaggaagagtctgatcagctctgacaagcaaacagcagaaagaagttttgaaaaaacggctaccgtttttgcagctttttcactgtggttccatggtgtttgaaatcagaatgtaatattgagttaatgacacaaggaaacacttggatgttcatattgtctacttggttttcatgaacctcacatggactggcttcatcctgtttcagagtccattcaactgtaatttccactctacttcctgtgcaggccttcctctggtttgtgggctgtacatttcagcctgctcctttaaggggccccctgagctgaaaatgaaagagacattttgttgcttctgctacctgcttatcgtccaatcccaatctcagattttctttttctattttttaaacccgagtagcacttttccaactagtgtgtagtttttctttcaattctctgctcttcacagtaattaaacaagagctagcctccttttccaaatcttgtttttgtaatacctttattcccaaagagttatgcttataagagtaacataaatgtgttaaacttggtattgatttgatgatttcataaaccccagactccttgaaattctgcaggtttttgtgaaaggacttgcttaaaatctttgctaatctacctgaattttcttccaaaggcagttatatacaatgtttcttaaaactaattctccaaatttgcaatttggcagcatcctactgggactctagaaggctgataaatcatggagagtaggtattcatataggaactatgaaagctgtatgtagtaaacactacttaagaaggccttacatttcataaaaagttggagatttttgtggagactcataaaatgcatcctttatatcagtgaagtttttgcttctaggtatattatactcacatcgaaacactccagggattttgttttcagcctgcatataccacgtatatttattatctggatagataaattagacgtatacatttaaaggagtttgcatcagctgctgctaggaagtttttcttgtgttagttaagatcctgtgaaacaacccttgacatttcactagctgcacagtttgtaataaaatccattttagcctgaggttaaatcatgactgtggtcctcacatcatggtgggggatcctggtggccagattaaaggaaactccacattctcatttctgacttccctacaaccttgtattaagaccttaattgaaaaacttattgcctctctcaccaaaatatttcaaattttaatagtttcccccaatgaaattacaagtactattttacttttttcagtgcccttggaatttcgaggctggatggggggcttcaatgtctgactcattaagtgttctatatacaaagccctacatggtccctagagcatagcaggcattcagtgaatgaaatgaatgaatgaaaagctagagtcacattttagtgacctaactgtatattttcagagtaatgtagtgcttaaaaaaggacaatgataacacgtttctacaaagagatgcatgacagataacacttctcaagaagaaggaatttagcttctgtcatttgatctaggttttcaattacagaagcattgagaatttcctgtggctggataagggcgaatctttaaggcaagttgaagacccaggctgcccatgtggacatcaatactcccacagagcactcttcatgaagaaaagtgtgggcttgctgtcttttcatcaaaactcgtagaatttggctgactgcctggtttatcccaggacattagtcagcccacaaatcccgcatttgtttattcagtccagagcaagtgaatactgccattttctcatctcctttgttggcaacactttgttaacctgaattgggttctcaacataaaatgaagtgactaatcttttggggggttccccctcccaggttcttgtatgagcaactaaatctacacaccacaaagccccatgctgtcattttttctcatcctgcccctttattttgatgattccacattgtagttcatgaaaccaataccttctagagtgtggctgaactggcgccagcattaagaaaaggagtttccaaactttttagttttgtgagaaaatgttagaggaagagggaggttaggttgactatttatacttatgtaatcttctgtgaatttgcagtagttatcaccttgtactctcaaaagttttctagctctgagtatgtgaatctgaaagtgcaggaagtaggaatcttagcacaaaacaaccagtttggattatcacacaattaatatgggacggagctggaggatggacctgaacagaatgtatattctttatcactaggttatttatctatctacagatgtctagaaagacctgggcttttttagcaaacgtttgagaatctaggtttctaagtttccattgaccatgaaagagtgattagttttagaagacagttgggggcaacattgtgcaagtcagaagaggggatgaagaaaatcataaagctaaacatgtttgccataggcccaggctgtttttcagcatgtttcacctagcagcttggcagataattcccagtgatcattaggtctgtggaaattctgtttggtttataaagttttggccctgactatgtgtaccactgataacttgtttttctctctcttcccttttcctccaactcgtagccagagctaccttccagatgacttctttctaccactttctttcttcccagtgtaagagaatgcaagtatatgctgatgtttggagcaagaacattcaaaaattttcttattaacataacttctaatggaaatacagtatactactatggtgcatacaaagaagaaatagcaacatatatttgttttagacctgattgctgtattttattccttaggtcctccttgatgtcttgtagaccgtcactagctaattgttacagccatcgaaggaaaaaataaggatttttacttaggacatacgtaacagaaaaagagatggtttagcaaaaaagcacaggctttgcaataagcagccttaaattaaaaaaaaaaaagttaactcataactaactgtgtgacctgggataagttactgaccctctttagggcttagggtcctaatctgcaaaacggaaattataataataaccttagctagcatttcttgtgcacatactataagctggtgataaacaatttatacacactatctcatttaatcctcacaacaatcctgtgagataggtactattatcatttctattttacagatgaagaatccagacataagaagtgaagttaagtaactttctcaaggtcgcacagctaccatatgatggagctggaatgtgaatctctgcagtttgacgccagagtgcatgctcttagtcactacatttgtctacaaatctaaaacacgtaagacacataggaggtgctcagttagtggtatctattattaaatcagactataaataatcaccaggcaatacttgaaaggccacaaacaatttcttaggatttgtgacaatactaataattataactgattatgagcataccttgtgtcaggcacttcttttcatagtatttcagtcattatttaagagatttattcttatttttatttttctagtgagaaaactgaggctcaaaaaagccgacaaatttgtttaggattacaaaaatatcaaatgataggattgaaaatcaaatccatatcctttctatgtgaaaacctgtgttctttcagctttttttatttttatttttttattttttatttatttttttaaatttttatttattttatttttttattttataagcctttttatttttatttattttactttatttgttgttgctggtgtttttttcttgagacagagtctcactctgtctcagctcactgtaacttctgcctcccgggttcaagcaattctcctgcctctgcctcccaaggagctgggattacaggcacctgccaccatgcctggctcacttttgtatttttagtagagatggggtttcaccatgttggccaggctggtctcgaactcctgacctcaagtgatctgcctgccttggcctcccaaagtgctgggatttacaggcatgagccaccacgcccagcctgcctgatttttaaaattattaaattcatatttgttatttatcagatgcctctgccactttattttttaaaaatttatttttattaaggtatagttaacaaataaaaattctatatatttattgtgtacagtggaatgttttgatatatgtatacattgtgaaatggttaaatcaaactaagatatctgtcatctcatatgcatgccatatttttgtggtgagaacatttatgatctactctcttagcaatttttaatattctgctgtttgacttttaaaccaaggcttggattaggacagtctttgtagcttagttttaggttcagggataacaaaagttgttttatcctttgggcttttgcaacttgccattttcttaatgaagatctgggagaaaaattagtttaagtggtttttaaaatagccattagctcaggacatactcagccaaggcaggataagtagttttgccagcattcttctgtaggtaggttggttgttttttgtttttttgccacagtctttttaaaaaatataactttaaaaaaaccttggttttctgtgattgatctttttcactattttttatagagggccaggaatatgagtaaataattcttgggcttgggtgcagatgatccacgtgctggcagacagaaatctaaagggacaaaagaggctgtcctttgaagatacttttcctggcttgggttttatatttttggatttgatttagtgaaaatttttattgaggacctactgcataccagacactcggctacattatgagaggtttggggggcctatattggcatatagggaggatgaataaagaatacaaacaattatagtacaaatcagaataaaatttggcatgcaacgggctatcagatagtatggaggaagaaagcatattttattagtggagctaggaaatacgttacaaagttgatagcattcttgatgggtcttgaaggttacatagatttttttttctttttttttttttgagacggagtcttgcagtgtcgtctgggctggagtgcagtggtgcaatctcacctcccgggttcaagtgactctcctgcctcagcctcctgagtagctcggattagaggctcctgccaccacatccagctaatttatatatgtgtgtgtgtatatatatatatatatatatatttttttttttttccagtagagacggggtttcaccatgttggccagactggtcttgaactctcgacctcgtgattcgcccgcctcggcctcccaaagtgctgggattacaggtgtgagacaccacacccggcggatagagagaattttgacaggtgaggaggtattccaatgcaaaagaataataggagcaaaagcacagtggtgagaaattggaggggaactgtgaaaattgccacatagattagaggcaggaaaataaaggacggctaagtttatatagtgaacagtgagccgcatggacacaggtgactgttttctcctttttgaacccctgcttactccagagtcaccacctctcctggctttctgccaatcttcttggccacagtttctcggtcttcttttctggcttctcttccttggcctgaatgctacatgttaagtgatgtcagcttcagttttcttaacctctcttctcttaagttgctatcatttaaatatctttaaatatcatctacatccaagtgacctctaaaccagtaattttacccatgacccatctcctcaactccggattgtatataaaactgtctactcaacatcttcacttttgatgtctaaatctctatgtccaatttagaattcttgattctttgctttccctccctcctggaaatcctgctcttaccagtcttccccatcttaattaatgaacctgacattcacctagtagcttagtcctcaaaactagggattaatctagatttagtcatttttcttactcttgccatataataacatattattctgagtttacctttacccgaccccaaataggtaactgctgtttttgttataagatagtaatatttgcctctgagtgtatgtgaattattttgataaaaataaatattatttttaaaatattaattttacagggattgtctcttgatttctttccaaaagttaactcataagttgttcagcagagctatgtattcttcagtatgttataatttcgttccatcttccaaaaggccttcacattctcttggcttacagactcagatgctatggattagatacacaagtacatgttcctgtatatctattatatagtgaacataacaattatgattgtgatcttccaaagctcgtatttttaatcaaaattaattaaatattttaagccaaagaataaaggtagatgcagcatctagtcaaaaggatatttctgctggccacactcaggaagacataaagatatagttgtagaaagtgatatagtattggccaggtgtggtggctcacacctgtaatcccagcactttgggaggccaaggtgggctgattgcttgagctcaggagttcgaggccagcttgggcaacatggtgtaaaccccatctctacaaaatacaaaaattagccaggtgtggtggtgggcacctggagtctcagctactcaggaggcagaggtggaggattgcttgagcctgcgaggtggaggttgcagtgagctgaggtagtgccactgcactccagcctgggcgatagagtgagaccctgtcttgagaaaaaaaaaagcaacccagtgataggctgggcaaggtggctcatgcctatatttctagcagtttgagaggccaaggcgggtggatcacctgaggtcaggagtttgcaaccagccttgccaacatggtgaaaccctgtctctactaaaaatataaaaaattagccaggtgtggtggtgggcacctgtaatcccagctactggggaggctgaggcaggagatttgcttgaaaaaaaattagccaggtgtggtggtgggcacctgtaatcccagctactggggaggctgaggcaggagatttgcttgaatccgagaggcagaggctacagtgagccgagattgcgccattgcacttcagcctgggcagcaagagcgaaactccatctcaaaaatgaaacaaacaaacccagtgaaaaccagtattgaaaatagattgcctctcccttgcttcatggtctgttcttacgtaattttcaagataagttcattttggcgggtactgacaaatttccatttatttacttttttcccttacattcatttcttctcagtctctccaatgaacgccttcactgatatccaaagcatgaaggacacaccagggaaaaacatagacctaacacaggacaaatggaattattagaaacattttctagcagaagaacactattctgttgccatttgaatctttgcttctttctaggtttgacaatgagcctatcatataagcccaaatgtaaacagaaagaggttgaatcagtcacgataagcccaattatgctgtggtaacaaacaacctcaaaatctcattggcttaaaatatacagaattattcttactcatggcacatatccatctatcatctgcaggggatctgctcactgaagtcacttaggaacttggactgatggaacggccactttttggtcactatatgtattaatctgttttaatcctgctgataaagacccaaaattgggaacaaaaagaagtttaactagacttacagttccgcatggctgaggaggcctcagaatcatggtgggaggcgaaaggcacttcttacatggtggcagcaagagaaaaatgaggaagaagcaaaagcggaaacctctgataaacccatcagatcttatgagacttattccactatcaagagaatagcatgggaaagactggctcccataatttacctccctctgggtccctccctcaacatgtgggaattctgggagaaacaattcaaggtgagatttggtggggatgcagccaaaccacgtaatttcacccctggcccctccaaatctcatgtcctcacatttccaaaccaaccatgccttcccaatagtcacccaaagtcttaactcatttcagcattaatccaaaagtccacagtccaaattctcatctgagacaagggtagtcccttctgcctatgagcctgtaaaatcaaagcaagctagttacttcctagatacaatggtggtaccagtattgagtaaatacagctgttccaaatgggagaaattggccgaagcaaaagggttacagggcccatgcaagtccaaaatccagcgaggcagtcaaactttgaagctccaaaatgatctcctgtgactccaggtctcatatccaggttatgctgatgcaggaggtgggttgccatggtcttgggcagctccgtccctgtggctttgcagggtacagcctccctccaatctgctttcaccggctggtgttgagtgtctgtggcttttccagatgaatagtgtaagctattggtagatctaccactctggggtctgaaggacgatggccctcttctcacagctccactaggcagtgcctagggactgtgtgtgggggctctaaccccacatttctcttctgcactgccctagcagaggttctccatgagagccccgccccagcagcaaacttttgcctgggcattcaggcatttccatacatcttctgaaatctaagtggaggtttccaaacctcaattcttgacttctgggcacccacagggtcaacaccacgtggaagctgccaaggcttggggcttccaccctctgaagccacagcctgagctatatattggcctctttcagccacagctggagcagctgggacacagggcactaaatccctaggctgcccatggcgcagggaccctgggtccagtccatgaaaccactttttcctcttgggcctctgggcctgtgatgggaggggctgccatgaaggtctctgacaaggcttggagacattttccccatggtctcggggattaacattaggccccatgctacttatgcaaatttctacagctagcttgaatttcttcccagaaaatgggtttttcttttctattgcatagtcaggctgcaaattttctgaactctgtttcccttttaaaactgaatgcctttaacagtacccaagtcacatcttgaatgctttgctgcttagaaatttcttccgccaaataccctaaatcatctctctcaagttcaaagttccacaaatctctagggcagaggcaaaatgccaccagtctctttgctaaaacctaacaagagtcacatttgctccagttcccaacaaattcctcatctccatctgagaccacctcagcctggattttattgtccatatcgctgttggcattttggacaaagccattaaacaaatctctaggaaattctaagcattcccacattttcctttcttcttctgagcctttcaaactgttccagtccctgcctgttacccagttccaaagtcacttccacatttttgggtatctattcagcaaagccccactctactggtaccaatttactgtattagtctgttttcatgctgctgataaagacatacctgaaactaggaacaaaaagaggtttcattggacttacagttagttccacatggctggagaggccttagaatcatggcaggaggtgaaaggcacttctcatgtggcagtggcaagagtaaaatgaggaggaagcaaaagtggaaacccctgataaacccatcagatctcgtgagacttacttcactatcaggagaatagcacgagaaagatcggccctcgggattcagttacctcaccctggatacctcccacaaaatgtgggaattctgggagatacaattcaagttgagatttggtagggacacaggcaaaccatatcactataccacaagtttttttaaaaaaacaaacttttgagaatcttgtactgataattaatatctggtctggaagtgaagcacatttctttttcttgcaactgattggccagaaccagctagatggccccaccaagccaacattgggggagaactgaaatatttggcaaacagcaaccatgaccatcacagctggaagttctcagtctggaactccttccccaggcctcccatttctggaactctgagaacaacaatccaggaatctgatgacatcttttcctttactagccaaaatctgatgacattttttcctttactagccaaaagggagaacaataagcaaataaattcaattttctcccatttatacttttaaatctgagaacgaattgtgtgtttataagaaagtgagggttgagcatcatgaagaaaaatataaagatctttaaaaagtatatattgggcctattagctacaaacatggatcattattaatatgtgtctgactgacatttaaaatgcataatcaaaatcaagcctgttagatacaaaattcatccattaatagcaactaaatttcattaggtaagtagtagtgctatgtttaaaagagtaatctatttggaaacaggaattaatactcagaatattattattaatatatttgaaaattacttgtgtttatttgtcccagcccttacaaggtgtgtggtaatggttaaggtatttctcctctatatgcctgagttttcttctttacaaaaggggggagggaataatagcacctgattttacttttgttgtgaagattaaatttgtacatatataaatctatatatctatatatacacttatatatgtatgtaaaatatgtaggcttgtgcctgacattaaatactaaaaaatactagctattatttttatcctcatattatcagatatgacacattcataatttaaacagaagcctacgaagaactcataaattaaaagaagataatcttttcacaaggtaacaaattttggaacaattttttagagtctctagacatctgttactgacgttgtgagtgaaatgggtctgtgaagggaagatacaggtggaactgggccagtgtttgcagaggaccatgatatttctatatctctgctggctccctatcagttctagagctagttcaagtgaagcctccataacctctggacaataaaaatgcaccatgctattgttagcatgatgaatgaatttatttttgtttagcttacagaaagttagtagttttcaaaagggtctttatgtatacaattgaagatactacattcttgaaaaggaaatctttacagcatacaggtccctggcactaatacctcatttctgggcacagcttgatatggaggtatagtttgtgttttatctgaggaaaatttaggttggtgttatgttttgggctagctctgctgaaacattattctcttttcttttagagccagggctgtgggctgtgtcacttgtgacttggcagcccttaatggggctacatgaggaagacatttccttacatgattccaagagtctttctctggggttctgaggtagtctctgtgtttcttggagatatcgttggctctaaaatttcccctaagtgaggtgatattctgtcatctcatgcatgggttttggaggctgaggggtgtctgggttggctccaccacctaccagttgggtaatattgtgtagttttttttttaaacctttctcagctttagtttccttatttgaacagggttaaaaattgggcttgagagaaggattagagataatattagtagatattgttgatgaattgggcgaagcagagggagggggcaaagttgactacctttgtttctgtctcaaacaagtaggtggtgatgcctttgaggagataagaaaagtgacttgtgtgtgtgtgtgaaagacagacacacacacatatatatatatagagagagagagagagagagagagacttataaattttggatatatggtttcaaggcacttttctggatgcataagtgtaaatgttcagttgaagttttaatggtgcttaggagagagatgtgaacgataatagagattccaaaggcctttacatcaagaggataactgaagctataggagcagatgaggcacacctgtaaagatgagacaagaagaaagcctagggtagctctgagaactttgctatttagtgtcctcatagaggggatggaggattcttcacaaaaagttcagttttgtgacaccacattcccctgattttactcttacctcttgagacaccaattttttaatgaagaagaaaattatgttgcctgcttaaagtaaggaaagcaggtgttggtgggattccttaatagaaatatagaggtttaaaatacctacaagagtaggagatagaattgatcaagtaaaaaaattgaagagattaattgaggacttaacatcagagaccatatgtttgttgtgacaataatccaaattattgtaataatgtgtttaggagtatttagccttgtaggtaccaagattgcattgatcctgtgttaggagtttgccaggtgtgtgcaatagtgagaaagacatgaagggatttgaggttgctgatgagtgaccagtttagatgacaactactgtttcttcaactctttcttcaacttcaactgtctgttttgggaaaggctagtggcctgtgaggaaacgaagaccccggagctggaggactcaaagagtttggagagcagacgtgtgcaagtgagggttttgtgagcactggaggacaggcagctggggaagagagtgtgttatttgcagttatgatattgggtgtggagctatttttggtggcagcaaagctcaggatgtatttttttattattcccataggtgatggaggctttttattttgccacaaaaccactggtgacgttgcctgtggccaccttggagaagacactggaggtacacaggatgtatccctggaagtggcagggggtataagtttagtaggagatttgttactgagtatttaaggtctaggaacagattgagggtgttgggtggattgcccactaagacactgggttttctagcatgatgacagaaattggagtttggggggagaagagttctattgtgtcttgaagaatgtgatcaggaggtatttctaatgacacaaacatagaagtatacacactggtatagtcagatggcatgagtaccaaggtggaagtgtggtggtcctaaagtggcattaaggagccaataaattgtcattcctaccttagctctgtgtcagatgaaatacacagcatagtgtggggagaaaatgttgggcttattggggatggggtctttcacataaaggaagaaggtttcagaaggcatagtggtatgaaaagaggagaaaccaaagggaggaaggtcaataaagggttaagaacgaggggaggcaaattgactttctttcagcatatgaggattataggaatggaaaccttaattggaattaattgaccacaaatattccaaagatggagtgaatcagttcgagacagagatatctgagggtctgagggtctgaagtaggatttgtcccagtcgtgtgtgggtgggttcactgtgtggagcctggggtcttgaggatctgaacatgggctgcctcctgtgtgcacggtggaggcatctggcctgttctccctggggtggactcatgatgagctgagtggccaaacacacaatggttttcatttaacatctcatttctagcctaacgacaaacctaaaaggtgggcataacaataatgttaataaaacatctgcatttctcccatccttggagttgtgaggatttaatgcaattgtttgtgggaaagcactttaacaactctaaattacgatatatatgctaggttttattgttacccacacctttgatgtatttctctttgtactcttcactgtatctgtaacacattccctaggataattagggctaccctttaacaaagccaagattctatttatagtggtaagctggcacctgggctgattctctctagtgattatgtagttttgatgtggactggcattcttccctggagtttgagtacctccgtcagcacttctcccgtccagaagttccatctctgtgtttttctattacaaagcccagacacccatctaggccacccaccaggttcctctttccagtcttaaggacatctttagctcctggctcatttgtgagatggagtggactgacatgccctaagcaaagattgccagcctggtctagttttccaggtctcccttgactcgacaataaagtaaccactagactttgagaattgcagttttacattgtctagagtcttctagactttcatgaagataggcaaatatgattctaaccaagatgtattaatacctcctacttcctttgaaatgtaactgagactgtacttgagacgttacaatttcttggaaggggaaaggaagcttctgctattgaacgaactttttgttaaggtagctcccaagcaggttcagtagctttgttctattatcacttttctactgacagtgatttttttcctttgaaggcctgggacatggagactgcttttctgcagaaaccacatcccttggagtaatgagctacacctacctcaattattcagtgcagtacaacactccaggtcagctattaagaggtgcacacattatttttagaaaatgtgagtcagtcttggggaaaacaaatctatgctatatgttctttttactcacttgatttacaacatactgtgatgtattctttttctattcagcatctttttgtacccgtagctctttgttctgagcataaatgtgaccttttggcttcaggtagaaactctgtctcatgagcactccctggacacggaagttctttgaaatagcattgattttgtttaagccttcatgttcccctggaaggctgattaaccttagtgccttctttctgtaatagctcatattgaattatctccctctgtctgattatatccatttgaatcacctgcaagtttcttttacatgtctagagtgaggacaatgtgggtgatgaagagctgaaatcttctaggtaaacattagatttttaaaaattctatttttttttttttatttttaagacagggtctcactctgtcacccaggctggagtgtattggcatgattacagctcactgcaaccttgaactcccaggctcaaacctgagcagctgggactacagatgcaccaccatgcatggttagttttttaatttttttttgtagatagaggttctcactatgttgcccaggctcatctcaaattcatggcctccagagatccacctgcctcagccttccaaagtgctgggattacagacatgagccactgcactaagccaaaaactcttgttcaaattacattttctgccttagtaatgctgctttcctagcttctgagaatttctaagacccaatggtaactctatgctaaaattaaaatacgaatgtccttttcaaaactgcacaatatctttgctattgtcaataatgtctcaataaacataaaatagcaaagagattgtgcagttttaaaaagaacattcgtattttaattttagcatagagttaccatcgggtcttagaaattctcagaagctggaaaagcagcgttactaaggcagaaaatgtattcacaatagcaaagacttggaaccaacccaaatgtccatcaatgatagactggattaagaaaatgtggcatatatacaccatggaatactatgcagccataaaaagggatgagttcttgtcctttgtagggacatggatgaagctggaaaccatcattctgagcaaactatcgcaaggacagaaaaccaaacactgatgttctcactcataggtgggagttgaacaatgagaacacttggacacagggtggggaacatcacacaccagggcctgttgtggggtggggagaggagggagggatagcattaggagaaatacctaatgtaaatgacgagttaatgggtgcagcacaccaacatagcacatgtatacatatgtaataaacctgcacattgtgcacatgtaccctagaacttaaagtataataataaacaaaaaaaaccactgcacaatctctagtattcagatggagactaagcatgatttttcttataaaagagcagatcagaatgttgtatcttttattcagaagactggagttaatcactgttatctttagtacttagtgctgccaaggctgtgtgttcacaatgaggataggatgtcaaataaatgaagcttcatagaacaagagcaggattgagtcatgtaggcaactgtttcagcttcctcacctaacttagcaccaaaatgtgttattgtcattacagagtgcttatttaaagaaaaataaaaagaacacacacacacacgcacgcacacacacacgcacgcacacacacacacatgtagctacatgtctaggaaggatgtggagagctgaaatatgaaggcaaaataaaacatctttttcaaagtatacagcctacagtggttagcacagagctggccacatagcaggggtttcataaatgcttgttgattaaactcttttttttgaaaacaataatgtagaagcaaagagcctaaagtgttttcataaatcttaagtggtagctttatgttccagttcagcaaaacacaaatttgaaggcaatctgtacgttagggttcaggtgaagaaggcaaaggaatcaatgaaattgtaaaagctttccaaatttgccttttctcttaagattgtctttctctcattctcttctccctatttcaggaatgcaaatatcctgtttcatcaatcttttgttttctgactcaagataacaacaataatttattgagcacaaaccatgacttttgggtctgtgtagccccgaagcttcatagttcaatatctgacacataagaggggcttactctacacttaaatgttagttttgtcctcacttttttctctttctcagagatctcccttttcccctacttgtataagcatgaagaaatctttcttttcattctctccaagtttaatcagacaactccacatacatacatctttgttcacaactatgaacaagacagaaaagttgctggacctcaaggactttacaatcaatctgggaaggcaaacattgaacatataatgtccagtctgataagtgttagggaaggaaagctcagaatgcaagggaatataatctaatctaggagatcgtgggaaatatcactggggaatttggaactgaaagaaaaataagatttgattaggggaaattgaaggatcagggagtcaggcggagaagaatgtcccggcagatgagacactatgtaccaagcccgagtttgacagagagcgtggtttacagaaggaatctaaaaggtgtagtttctgtagcagaagtgtaagggtgttactcgtaggaggcctctattgaactcttttccagtgacgtagtgtgtggtctttaagtggctttgcaatgatagtaagatcagcattgcattactgaatgagctcctttagtaaacgtggatatgtgctttctgaatctatttgtttgtttttcccaagtcataaacagtgaatcaagcaaatgaaacataatcaagcttggatagtatcttccactaatttccttggtcttaagtaagactgacagtaaactgatggtcaacctgttcaatgggctttaacaagtagtagccacatccaagtcaacaaacagtacaggcaatcagggcccctggcctacagtgaatcatgggaattaccccagggacctatgctttggggactcgtccttcctggcagctatagatgccatcagaaactcatttgcacactcttataaccaagataagggcaatggttagtcccctgtcattgcatgttagctttctttcccttttctaggctttttcagatgcctcttttacattattacttttcctgtgtgaaaataatgcgtgggaaatgggtaggtcatacagagcgataatttcattcctgggcccctgtcttgcagctccctaagtaaagttttgcgcctggcactcctctggcatagtaacctctgacaaacccttgggtaatagaggagtagcaaaacccatgggtaatggaggagtagcaggaatattatgattagctaacaaattcacaaagtacatagaaatttttttctcgaataaccactatagctgaggaatatagattagtgacaaaattgtgcactcaaccaactctattaaaagtatttcattattcccgtgaaaaaactcctaggaaaatgattcactgagagatatacgattgtataagtattgagaaacagtctttcttttttgctttttatttatttatttaatagacattatagttacacataattatgggatacaatttgatggttcgatacatttttatgttgtataataatccaatcaaggtatatttagtgtactcatcacttcatgcatttattattcctttttgatgagaacattcaaaagcctctcttctagctctttcgtaatatcaataccttactgttaatcatagtcactctactgtgcaatagaatgctagaatttattcctcctattgaattgtaactttgtacctgtcgaccagcctctccccatcttcttccccttccttcttgcttccccagtctctggtaaccactgttctattcctttttttgttttttctttttgcagagttcgctctgccgcccagactggagtgcagtgcacaatcttggctcactgctacctccgcctcccaggttcaagtgattctttctattttttgggaatgtgcgttatctaatacttaggtgcctcagatttaatggtggtaaatctcactcattttatgaaaaccaaatgaacactatcctcacaatggttagaaagcaagatcagctcaactttatgaaaatatgactataaaaccatttattattgccaagtggttggagtggagttgacagaaagatgcattattttaaattgtgttttagatgacagaacaggagtcagtaatgttccagtttggaggaattagagttaattggttaattgattgattcgattcagtcaaatttattgaatgactgctgtttcagacactgtatttggtcctgggaaaacacagataaataatatataattgtattataaattaataaaatagttttttccctccaaatgtcagtagtccttggaaaggacatgtaaacaatgaatataaagtgacacatagtccagtcaagataggtaggaaggtctaagtacaattgagtggtcaatttcacttcagggaagggcaatgatcagggaagatttcccagggaaagtgatgcttgggcaaataagtaagcattttacaaagagacaaggaaggatagggcgtcctgggcagaggaaggagtgtgtacaaaggccaagtgacatatgacaacattgtacatgaaggaaactaccatcaggcagagctgaaatgttggcacatggtgaagtgctagttaccggtcccagccatgacagtagtgtaacaaatgcctgcctctggtgcacagcaagatattaagattcctcaaaacagttcatatattttataaattaagatagacattaacagaagctcatagaatcaattaatgcaaatgtaagtgacctaagaggcattttgttcagcatagttattgattttgcctgacccagaggatttgaatttaggaagatgtaagcctagagtagctgtcagttatcttgtgatacatgggccttggaagcaaggtacagggacacagtggaccaatgggggaagattaggtcctggtgatgtgattcaagccactggattaagccacatctgaaacgtctatttctgtactcttcagttacaagagatgttagtttgaattatttgcttaagtcagtttttaaaaaattcaattgcaacttaggagatacatctggcctcttcattttacaacttaggagactaatatctagtatgacaaagtgacttgccaccaaatggctggttaaaaactgataccaggacccagatctaatgactcagaggccaggcttagaaatatctagctttttttttttttttttttttttttttttttagacacggagtcttgctctgttgaccaggctggagtgcagttgcgcgatcttggctcacagcaaatttttaaagcatctacatgtgagggcctaagtatacgagtacctagaaatctattttgcagcaactatatatttgatagagtgattgagtttagtttaaagatgacatttctaagtggtagtgctgtcaaaagagcattgcattgaatcaagaatctggcattctgtgttcatagttcacttttgccactaattatttttgtgaccctgggtatttctttctgggactgtattcattggatatgagtatctctaaatcttcttcaacttctatgattctaaatggaagtacactcaattttcaagtatccattgtggattttatatactgctatgtatcctgagaaaatcttccttttgaattatttttcgtattaatgagttcaacttcacaaatatttactgaacaccaactatgagctaggtgatgtaaaagtgaatagttacttctagtcagtattacttacttacttttgtattccacagtgcagtttgatattgtttgtagttccaaagcattaaacaatgccttttaatctaggacatgtggaatcttcaaataagagcagaattacaaagagttttagactgccactttgcatcattctgagaggcaataccataagtgttcagcagtcagaagaagggacaggggaaagtcctgagcagtgcaggtggattaagaactaaatatgcctacaaaagcacattcatgcctaaatgtcattgcatttggatcacaggccttgagaagatctgtaccatcactgtgggtaacttgggcccatttagagtacttgcctctgagggaaataaaaatttgctagcaattttctctaaatgacattatcataggcacttaattccttgataggttcttttagataatttttttataatgaagcaattaatttgattcacgaaagtaagtttctagtttatataaagaccagatctggcctatttcttagcttgtctacatttgagtagttccattgctggaaaatgaccctggagcttttcaatctcatttgaagagtccaggggacagacagagacactagttatgcagtttactagagccaggttccatttcatctctaataatttttgcctgtgtgcgcctgcacatgtagcttaagctatctaagccttagttagttttgtcatcagtcaaaggggaatagtgatatctccctctaagggttgtacaacatggtggttatttatagcacagcttgaataaatgttattagatgatatagtctcagtcaggttttccttggaccatgttttagtgacatattagactccaaagaagcaaaatgctaggagcacaaggcagcctaacttgtgagttgatgtacagtgtgaagatgcaccacagatttagaatttcagttgactagaagaataagtggtagaatttgtccctggttgactactgtcttaactttgtgtctttggggaaatatttaagctctccagacttctatttcttcatgtttaaatcgggaataatattcctttctcatttcgtagaaattgaaaggagataagtatgaaagcgtttatgagagtagaaatcatgagtgtgaaagttcatgctattatggcacaattgatgttgaaagttaatattacagaccattccttttttgcacagtgaaaattgttttatatccatattggcccctgtcacatattaaaatattattttctcttattaatttctatgagaataatactgccttcatacttttataaagggacctaggaaaccaatatttgtctaatgtttcaggctaaagagtaaaaaggaataggtatactcttgaaaatagatggctattgtcaatatttttcctaccaagaaaataattccttctctataaagaactgttactgtttagagcaatattttcacgattcaaaaagattatctgagcatgtgtccaaccataactgacccctgcaaaatatttctaaaagcactgtgcatctaggctgggaagtatgcaaaattagcaaaaatcccctagcattttcacaccaagccatgtgtatttaatatacaccacctcaaagaggaacattaccaccctagcactatgagtgaggtgagacagagagatttctaagaatatatgggtgtaattttctgttaactgagagtgattgacagttcgtggaaatctgccctccaaaataacctgttttgcagcacccttagttttatttgatatgaagaaactgcctgctgttttgacccatttagctactaggaactctatttactaccctaactgcctaaatccctatggataaattaggcagtatctgtttattttagtttagatttatttttaaaaccagtgttcctttgactgttcttactatttctatttgagagttggttgaaataagatcatgtaaataaaaatacaatgtagtctagatctaaagtcactgtacatacctagataattttttttttttttgagacaggatcttgctctgtctcccaggctggagagcagtgttatgatcacagcttactgcaacctctggctcccagattcaggtgattctcccacctcagcctccctagtagtttggactacaggtgtgtgccaccacacctggctaatttttgtatttttgtagagatggggttttgccatgttgcccaggctggtctcgaactcctaggctcaagtgatctgctcatcttggcctcccaaatgagaaggattacaggtgtgaaccactgtgcttggcacctagaggatttcaataaaatttgaggtcctataattttaagatcacatttccaaaggaaggagttttgcttcttttcaaatgcatggacaatgagcaactatattgttttggtaaaactagtagtcccaaataagaaagaggtcctactagtccctagtagtctagtcccttgactagaagaaaaagtcaagcccaatttattttatctgcaggacttggtttaagggggattataaaactatcaccacataaagtctttgatgaagaggacatagggggatgtagggagtacttcagagatgcatctggtcactctcgaatacataacacatttacataaatatatatatccaagtaaacttcagacttcacatatttgtttccttttgtttccttgttgaaaatctttatccaagctgacaatcacagtacactgctcatgtagattccactgctgagagctggaagctgagagtagagtgggctggggagcgactttcttgggactattatgcttttcttgcactttactaggttcctgttcttccccacccactacctctcctgggcactgattccaggcaagtgagatgcatatctgtggactatggttaagtgaaagcctttgttctggaaagctctatctggtttctcttaagccagacagaccagcttgccatgaaggctttcataggctctggtccacactttagacttccaactggtctgctactgacattctaggctattgtttctccaagtaatgaatgagtataccattggtggtggaagagagaattttagatggtacatagacaaatgtttttattgtgattgttatgtatttttaattcatatgagaaaaatgttttccattcatggtagcaatatacagtttcttctttaaatacatttacttaaaaatgtgagttgatttaaagagaaatattaataagacttctggggaaactcaggcatgacaaaatacatgaaggtgacatgtgagtagttgaggtttagaaagcactgcaatgttatagactctaggctagctccctgcctatccccaggccagttaactagttgaattctctcaagagtcaggatgtctttgcctgttggccttcaccttaagaaagtcaggcaatgatgaggaatcacacctgaggagattgtaggagacctttaacttaaagagtggtgatgaatatgaaagaaagagtcatagtatatgatcaaagcagagaggactttgagactcagcgattgggatgtaggaaggtttcctgtaaaaataaagtcttaactgggcttcaaaggatgaacaggaattatcctgtggagaaaagtaggagaagaatgacatatgccaagtttgtttcttaaaaccacaacccccaaattgtgagctctgggtcttaatttggtggggatgggaagcgccaatctatctgtgacttctttcctgacatgggctttcaagtgcatgtaacttgacatttatgatttcctctgcaaaagaagaaaggaacagggtgatggtgcctctgtgatcagttgcatttatgggtgcaacagcaaaggaggtgggacacctaagggacaaccgttcacgtgaaatgaagcagggatgagaagaaatgcccgtttgtatttaatacatcccagaaatgaacccctttattttctgggactgttagagcagggaaactatatatttctaagaatgggggctctgctcaaatctttgtattacagtacaaagaagggtgaggacaggaagcagtggtgatcttgctctttttggaagagtttgtgtctgtccttttaaagtcaggtatgattgataggaaagtcaagtactggcatcctcagattggagaggttttattttattttattttttttaatggagtcttgctcttgtcatccaggctggagtgcaatgccacgatttcagctcactccaacctctgcctcttgggttcaagcaattctcctgtctcaacctcccaagtagttggattacaggcacctgccaccatgcctatcttaatttttgtatttttagtagagacagggtttcaccatgttggcccggctggtcttgaactcctgacctcaggtgatccacccgcctgggcctcccaaagtgtgggattacaggtgtgagccaccacacctggcctgagtttaacataaacaaagaaataaaaataatataatctctcaaaatagcaaagaacagggttgtctaatcaaaatatataactatttatttttaatagccacattacaaaagtaaaaagaaacaggtaaaattaatttaatttaattttaaaaatatattttaaggtatacaacacggtgctatgggtaaaatggttattacaatgaaacaaattaacatctccatcatctcacatagttacctgcttcccttcccactccaaacccctcattgcaagagcagctatagtttactcatttagcaaaaatcctgaacgcaatacaccatttttattattttttaaatttatttttttgagacaaggtctcactctgtcacccaggctggagtgcagtggcgcaatcttggctcactgcaacctccacctcccaggctcaagcaatcctctcacctgagccttgcgagtagctgggactacaggcacgggccaccacatttggctaatttttgtagagacagggtttcaccatgttgctcaggctggtctcgaactccttgggcttaagtgatctgcccacctcagcctcccaaagtgctgggattacaggcatgagccatcatgcctggcctacaatgcactaatattaactatagttggcaggttgggcattagatcttcagacttgttcatcctacatatttgctactttgtatcctttgaggtacatctacccatttcctccacccaccctacctctggtaatcactattttattctctatttctgtatatttgacttttaaaaaaattctacatatatgtaaaataatgcaatagttttctttttgtatctggcatattttacttaatataatttaaataatatacttcatttaactcaatatatttaaagtattttaacatacaatgaatgtaaaaatattgaaatgttttgcacttttttcatgtaaatatttaaaatttggggtatatgttatagtacatgccatttaggacattaaattgccaatggaaataatattcagattttataacatttgcagttgaaaaagtagatacatgtatccaagttgctctcaacatacttaaagttttccaataactgaattaaatatcagtttatcagtttaatataaacaattagggtaaatgaaaataaaatttcagctctttggttccattagccatggttcaggagcagaatagtcacctgaggctagtgacaacgcttttggatcacaggaaagaagaaaaaaaatcaaaataatttttcttggtcacatttagctccttttcttccaggatgattacggagctaggaatttcctacgaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaatagatctctgtggcttgaatggtcctcagatatcttgaccaatgattctcaaatgcttaccatagaccataatttttccccacatgacactgcttcatatttttaagttttttttcaccaaatattttgttttactatctccaagccctgaaactttttttctccctcaaacatgacttcaactttactatcctggtccctttctattgaatgtgttttgtttgtgtctatatttcttatagtgtcttgaactgattgtacttacgatatgacttgactagcataagatagaatagggcagtcatcttctttgatctagactagatgctatccttctattaatgcagttgctagttttgtatttgcttgctttcaatttttttttttcagattttggtaaccactgttacttgactcgtatcaaacttatcagtagctaaaacccccattttccctcttcctgtgcttatttgactagttttgttgcgctttctgaaatgtttctcacttgtttttgaccaaaaaaataaaaataacaaatgccattgattctgtgtctatactatttgaggcagttaggcctttacttacttcttccaacattttaagcagtgttgcattcaatttgaacaagaggaataaaaaggcttgagaaatcttagggaagtgtgtctcaagctttagcaaacaaacaacagatctgcaggagatcttgttaaaatgctaaattctgattcagcaggtctggagtagggtccaagattttacatttctagtaagtttctatggattatgttttgagcaacaaattcttagagtgtctgaaaggtttttaaaataactgatttcccttcaaaatcttcttcattaggagtaaaatatacatcttctcactctgtaaatcagctctgagatcttctataatcttagctgaggtttgggtatgcagagttttgaaactcttatttgcttaagagaggagccatgtatgatcttcttttgggtttccccattgtctggtaaaatgaggagcattactaaacggcactcacttttactgagtttgtttggatcccacagagaactgaaaaagtcaccattatggaagccttatcagagagatggggacaagtcgccccaaagcagttgtcaatatctggaagatatttttctagttggccttatatttcatttctattttcctcagttctaattcagtttatcacaattaaaaagaaaccaatgaaaaacataaatattggagatcatttgatttcattggaggctggaaaggatagaaaggctgaaaagtggccgggtgcagtggctcacgcctgtaatcccagcactttgggaagccgaggcgggaggatcacctgaggtcaggagttcgagaccagcctggccaacatggtgaaaacccatctctactaaaaataaatacaaaaattagttgggcgtggtggcacgtgcctgtagttccggctactcgggaggctgaggcaggagacttgcttgaatgcaggaagtggaggttacagtaagccgagactgtgcctctgtactccagcttgggtgacagagcaagacagagtgtgacagagcaaaacaccatctaaaaaaaaaaaaaaaagggaaagaaaaaaaagaaaagctgaagggtgtgctgggtcctgtcctgggtgagggaacaacttgtggaaaagtgaattgaggcttatcggaatgtttggggctcctcaataatgttggcactctgagatacagaccaaaagtgaggtaaaaagcgagtgtttcctttttttcagaataggactttactccagattttcttactcttctcttgattccttcaccatccttgatcgacattcacctcagatgcccatgtcccttctccaccggcatagcttgttttcttcttaatcttcttgtgttcatctagcctcacattgcatttgtcacacttcgttgaaaacctactgtttgtcaaagtgtctttctagtaatccagatatctcttcccccatgcctttggtgtggtttcggtagagtcatacagagcagcaatgccttatgaaaacgaattttacagaatctgcctgttcatcaaaggaggccagacaggaggtgagaaaaaccaggtgtgtcccacaccagtctcaatgaagccttttggggtgtcttgtgctcttgactaaatctcagatggtactgaatgaataatcaccaaaggcgtgagctgttaaggaatcccagtttggctggctctgtgcagtcagatgtagccagccctgtttatgtgtgaaaggattgggttttccccaagctgtttggtaatgttgcaagaacagactttcccctccctggctccctggagtaaaatggctgccaaagtattttggaacagaaacttagaaatgtaccgaccactagaagagagtaacaagggtcctttgatattttccgtgttcactatgatcaagctggcatcgtttccttctgagctaaagattctgagctatcattggctgatgtgagcttgtgacctagctacttctgttcacaatacactgtggaggggcagcgggggcagccctatttgggttgagagtctttaaggagagctttacagatgagttctagtgaagcccatcagggagaagaaaatcaaacacaatgggaaatgtttaacaattaaaaccaggctttgcctgtgtggtcctgtgttttaccacatcactctatggaaatgggctgttggaaggaagactgtatttctgacagtttgcagagccaaaaacctgttgaaggctttttgtaaggtagtggagaaaatggcaaaacctttaaaacttaagggaaattacttgatagttctgatgaccacaggccaccagactgctgggtcatggaattatagctacatgacaaagaaaataggagggtgggctgagccagactcagaaactattccaaaagtactatgactttttaggaagctagttctttttatttgaaatattttgtgtttttttgcatgagaattagcctatgcttcttaaaaatatcataaaatgtcagctagtagaaaaataaagagtttaatctccactccgactacctagagtcaacccttgttcatactgcagtacatttttttcttttagttctgttctatgctttaaataaaaatacaattaggtccatatggcaatataattttgactccttttaaaactgtagcttatatcataagtctatttgatgttgttttgaagttgtcatgtacattttgtcatacaagtttttaatgactgtttttatggggttgtgccccaagttacttattcattcccatgttatcagatattttgttctttagctttttttttttttttttttacattataactaatgaggcaatgtgtcttgagtattttgaattaactctctagaatcgattcttggggaggttatttactttgaagtgatggacagagtgtaggagatttatgagtgaactcttgtctgatttggaaatatagagttgtttaggctaggtattaccaacccaaagttgacacttgagtcacctaagttcttctctactccagagacttggccctgcctggcctgatcccaggaaaagagattttagggattacagaaatgggaacaagttgtgggtctgagcacagcatgcaaattaattcaacacagcccctgggacaggcccatgatcagtgagctgaaactcccccttcaagtgctttcatgattagactccagcctaggaagcttgtctattagttgtgtaatcttgaaaaaatctctgacacttttccctctgactcagtttccccatctggcacccaatcttttacagtgttatgaaaaatagggaaaatgtagaaaggaagaacatggcacccaatccttaatggacactcagtgaaagctggctatcatcatcatttttggggttgttgtgttctacaaatgtattttcccaggagttttttttactctgtctcctctttccttcatatacccccagcctgtggctggggtcttgcttcaaccaccatgcacctttctgaaacccaagttttactccctgataaaggtattgacctcttgttggtctcatcctccagacctacctatacttaagaaaatgacatctctttaaactggtccccagttcacttgttttccctaacattttaattcacaagattaatcacttcccttacaggccagtcttactgcagagttgatttttataattttgggcctgttggtctggttgtacttttctctttctgctggtctgctagttatagcgggtcttgaaagcagtgatatgttatgacattgtcatcaccctcattattgctctttatataacagtagcagcataactgtgttttgatttcttgtacaaggcataaagtgtgctagtggctcactattcacatcaatctcatcagaaaatgttatttcctccttttgttgatcatgatatagaggcccagtgacattaggtaacttgctcaagatcacacatgtggaaagctacagagccagacttggaactgagtccattatatcttaatcccactgcactccaaaatttgttgaatgaaggaatagataaacgtatcatgattttgatgttctgactaattcgtagccagtactttattgctatcggagcttaagctttaagtactggctaggaaatagtcagaactttatttttaaggaggagcatataattatgtatattttatacctgtagtaaattgggaactatagaaaacatgtagaggattgtgtttaccaacttcatgtagagtgaggatacccgactctagcttgctggtagttaggtaagtcagacatgggcaggggataaaccaaattagactatttccatttgactaagccatataatcaggtgtaagccacggaaagaaatctggaaagacaggtgcaatattagaagatggctcatgatagtgatcattagaggttcaggcttgagaaagccaattggaatcaagaaggcctaatcctggggttctgtcacagaaaagaaggctggtagcaggaagaggacatgtaacatgaattacatgattagatttgtgtcataataacaaaaacaataatgataataacactaatagcttgttatatgccatgccctgtactaagaactatacgtatgttatcccatctaaatcacatttaatagattcccatttttctcatgagaaaattgcatcatacagagatgaactaacttgctcaaggctatagacctggtaattagcaaagcagggatttgaatttagatgtatttttctctgaaggctgggtttagataaatggatctggaagcactgggaaggatgaattaatgggatggagtgcaggggatgcagagtgcccacttatggaatgatttcattcaagagagacaggagggtcagaggtaagaatgctaccgctgggacagagaggaaggtacagatatgagatatggtaagaaggtatactacaacagtggctcccaaatctcaatgagtagccagttctcatggaggttttgtttttatttttgaatgaagattcccatggcataccttgaatattctgaatcagaatctctggaatacaacttggtattcttataaagcaccctaggtgatgctgaagctctgccaggttcaagaaccacagctcgatcagcctatatttagatgtttggggtggagaatgagagaaagaaaagattttagggtggcatccaggtttctgaattttgtgactcagtgaagtttttggagggtaggtaagatgctgagttcagttttggatgtgttgagatggactggtcctgtggatttagttggatattagagtctaacgcttagaacagaggtcaaggctgtagatttagatatggaggacactggtgtttgggtggtgatggcgctatatattacatggaattttcaaaatactcaaaacttcagttttccctcaataattaatcactttacatctttgtgatcttaaatctctttctgaccattgattgaaacttttgcttttaaaatttacattacctttcttaacagttccttaagattcatgcattgttgtaagtagttacttgcaccatttcattggattcacaccaacaattgttaaagtaaaatttatttttcctgtgttttagatgaagagatttaggcaggttatgtaacacacccaaggtaatatagtcaaataattgagccagaatttgagcccaagtctctttctgactctaggcttagagctttagggctatttcacaaaagggctgttcctaggtcaggcatgacaacttctatattaccttcgtaaaagaagcaatataatctaccactattaaattttgcaggttaattttatattatgtttaaatacagaaaactttatttaaaactcagttgaatttctcttgagaaattggccatgtagtaaattatatttaatagaagagtttgtgtacttcccagggagcagagtattggcctgatcaaagcacctttcagcctttgtctaacagcatgtgggtaggctacattttttttactctcagagaaagggggtgggcaggggtgtgatatgggtttttgtctctgggagttctgttgcatgatttgacctcccaaattgttttgtggggcatatccaactttgggttgaaactaaaatgggttcttggtaatcccagattgaaaatatgtctcagcagtaacattgtttatctttaggtttaggtaaatacagacatttgccatgtcttcttggtagcactgtaagaatgagtagggctgtgaaaaatgcacagggcattcattatgaagactggctggttaaaactgatacactaaagaaattgcattcttttccacaagctgagtcatacagctgaaattgtggaatcatctgagccagcagctgtaatatgatacttaatctccataagtgacagatatctaagataacacgaacacccagacgacaactcaggcaaccccagcacagtgttttggtatgagaacaggagaaatgttagtagagtgaacatttttccacagagaactcaaatatggtaacattctcatagctttgataatccccaataaactgtggttactaaaatgcatgacaaaaagaacttctatctataaagaacttctttatacatttccaatacttgggttatgatcaaggagaaaaaagtttatcagttaattaagagttaggtagctagtttgcccacagattaatttgtatgaggtaaaggaaatctcacctaactgggaaaaagcaagcttaccctcaaggtatgcttatcccaaccccaccctgccaagtgcattccttattcctcaggtgtgcctgtttatcccaaggacctagccacacctacatcttgttctggccccacaccaaggaacatataaaagttccctctctggccgggcgcggtggctcacgcctgtaattcccagcactttgggaggctgaggcgggcggatcacgaggtcaggagatcaagaccaccctggctaacacggtgaaaccccgtctctactaaaaaatacaaaaaattagccaggtgtggtggcgggcccctgtagtcccaggtactcgggaagctgaggcaggagaatggcgtgaaccctggaggaggagcttgcagtgagccgagatcgtgccactgcactccagcgagggcaacagagcgagactccgtctcaaaaaaaaaaaaaaaaaaaagtccctctctttatatctcagggtatcttggagtcactactgatccttgacctccctcctttctctgaccatgtctagacaagtgtccaggtctcctgtgccaaatgtctatttgttgcctggattaggttttgacttgtttttctatttctttgcatctcgtagcccatttctttgattcaatttcacaatctcttgattttgtccttaagtatttggcaacacaaaccctcgagaggcaggatagttcaacagaaagaagatgaaccttgggggtcagaagattcaaacttccagaatttaaatcttcattctgctattactagatttataaactttatcaaatcactctcctactctatcccttaattcaacatatttaaaattggaataaaaatctcaatgtggtagagttattattgagatgaaaatcagaatagatacaaagaacttgatagccccaaggagcttgatcagtgtttgtttaatggcccttcctctcttctcatatctcagttcagatcctactcagccatttattttattctgctccttttggagtagagaataaagccaagaattatgcttaaaaagtagcataattaaaagtatttaaaacacaagtaacttgagaaaggtgagttggaagtttatatctaacctcagttttttttggagagaaatttacccgtcagggccagattaaaacatttacaagtcccaagcacacgtgagatgaagatgcccctcacttatctcacatgtaagttgaaagttaaaaagtgaaaatgtctactagagttcaataatattctttttttcccatgacttctctgaagcttttagaaaatatgaaattcttaaaaacaataacagtaacccacatttttattgccctggtttgccctatcttatctttctcctgctcacagggtctgaggcagctgggataggggagaatgattaccagccaatcaatattttttgaaccccagagattatttatttatctatccatttatttattttgagatcttattttatctggaatcttaataaacgattagtttccaaactgtatctactgtgtgtattttatccatatggcccagatttgtattacttatttgtgattctgaataatattttttccaacattaattatcagcctctctgtgcccctccagaattgttacaacctatgttaatgcacactatggcaagccatgtgaattgcctacgcagggaagttttcttcatacttccttgccaagagaaccccattattggtcagttactagtcacatgatcttctttagcccctccttagcccctgtagtgaatcaggagtagcctaaggccatggtggtaactcccctttttcttggaaatgtttgatttagatatggagaagaggtgcaactttgcttatgaaatgggagggcaaatatgggaaactttaaggtaagttttctttccccttgaaggggaccaaaaagttgtggtttatactttcttgactctggtcactgttgggtgaagagttggtgctatggaagccatcttcagaccatgaggggacaagtctgaggatacaattacatgctaccggtggcagaggacagtatagcaagaaactggatccctgatgacattgaaccattgactgaatctaccctggaaccatcaggaaataatccttagttttttaaagatgcttttagttgtgttttttattacaagtacctgaaagcatcctaactaatcaatgctaaatgcatctctcacagtttatgcttatttttcagaaatgcctagtggaaatttctattgctgattataatatttgtcctaaataaattgaatagactgtcaatcttttgaaaataaaagcatgacttgattagcaattgtttagtctgatgttttcctaatttctgtcatttgcataccacttctttgattttgtcatatccttgtatcatctgcactaatagaaatatttttccttaagttgtctctcctttaaaaaattatatccatttattttgaagagaaactttttcactaactataaattgaaaaccgatatcatttgccttaaatagaagattgtcataaaaagaaatgccatgagtgaaataatgttattaaatatttgccagatatagtttcctatgaagactctgagcttgtggcttgctgtctctgttgaaaggagagactagggagtgttatagaagtggtaaaataatccttccactgactgagactatttccttgccacaatcagaagaactaaaagaaaggaggatatctgttaatatatgaatttatctaaatgtcatgcagtgacttctaaaatcatctggtgtgctctgtttccccttggaggtgacttaggcctggcatcccaaacaatacatactggagtgaagctccaggaaaccctgaggagaagagaagggcttaaagagcaatcagccttcgattgctgggattatgaaaggtcgtaagaagcgaatgttgcaatgttttattatacttgatattgaagcaaggacaagtaataatttattattctctccatgtcagtggtatttacctttttggaatcatgtgccccattgagaatttctggaaaaccatggttcttctactcaggagaatgcacaattgcacacatacacaaatgtgcaagcacacacacacacacacacacacacagaattgccacagaaggtcagtaggttcacaggccctaggctaagaaccagcattctgtatattttacatgtgttctcttacaagttaccgtgtgattcagttcactccaaactgcggttaagtgcaaaacatggttttgaatatttctatcaattagtaagagtggtatgttaatttaaatacaccaaagtggagaattactgtcctctcaatagctactttaaatagacataagttacagtgatattgccttccaggaggcttcaagaaatgagatcaggctctataaaagaaaatcacccaaccctataaagtcatctttatgaactttgaaacaccactgtatgtacctagtaaaaattattcctgggtaagcagactcccaggcctgggtggagttcacatgagtccctttgctaaaataaacagaagtgactgggaactttggattgcctttgtctgaacttgagtgtctggatggatcagcatcagcagcataccacacacctgcttgtccagccaaagagaaacccaaagacttggcatttgttttttacattgtcaactgtgcaaaaatatcacgattctaatttatgagggtccatgagttttaaaaacaccccctgacatttttctagccaaataatttttcctttaaaaggcacaggatgagcaacaagattaggtagatcacttcaatctctaatttcaaaagataatagttaaaaattcaactgtaggactaacacattaactatgtaataagacccagaatagtctttggagcaaatttcagtggatacttgatcaaaataatgttgaagacaaaatcttgaattgatgatatttatctgatacaattatttacataacaaatgttaaaagaattagaaaaatttcataggtaagatgttcattatcttcaagtgaagttacttgctttatattaagaaccacaaaaacttactaaacttttttttttaaaagggtctcactctgtcacccaggctggaccggagtggctcaatcacagctcactgcagccttgatctacccagattcaagtgatcttcccacctctgcctcccaagtaactgggactataggcacatgccaccatgcctggctaatatctctcttttctttttttttccccttattttgtagggacaagttttctccatgttgctgaggctggtcttgaactcctgggctcaagtgatcctcctacctcagcctcccaaagtgctggagttataggcatgagctactttgccccctagcagacgtcttacttttttttttaatttggtattagattgagccaatgactaatttcaaacatttataaattactaaattcttttttttaattatactttacgttttagggtacatgtgcacaacgtgcaggtttgttacctatgtatacatgtgccatgttggtgtgctgcacccagtaactcgtcatttaatattaggtatatctcctaatgctatccctcccccctccccccaccccacaacaggccccggtgtgtgatgttccccttcctgtgtccatttgttctcattgttcaattcccacctatgagtgagaacatgcagtgtttggttttttgtccttgtgataatttgctgagaatgatggtttccagcttcatccatgtccccacaaaggacatgaactcatccttttttatggctgcatagtattccatggtgtatatgtgccacattttcttaatccactctatcattgttggacatttgggttggttccaagtctttgctattgtcaatagtgccacaataaacatacgtgtgcatgtgtctttatagcagcatgatttataatcctttgggtatagacccagtaatgggatggctgggtcaaatggtatttctagttctagatccctgaggaatcgacacactgacttccacaacggttgaactagtttacagtcccaccagcagtgtaaaagtgttcctatttctccacatcctctccagcacctgttgtttcttgactttttaatgatcgccattctgactggtgtcagatggtatctcattgtggttttgatttgcatttctctgatgcccagtgatgatgagcaatttttcatgtgtcttttggctgcataaatgtcttcttttgagaagtgtctgttcatatccttcacccactttttgatggggctgtttttttttcttgtaaatttgtttgagttcattgtagattctggatattagccctttgttggatgagtagattgcaaatattttctcccattctgtaggttggctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtataaggaaaggatccagtttcagctttctacatatggctagccagttttcccagcaccatctattaaatagggaatcctttccccattgcttgtttttatcaggtttgtcaaagatcagattgttgtagatatgtggcattatttctgagcgctttgttctgttccattggtctatatctctgttttggtaccagtaccatgctgttttggttactgtagtcttgtagtatagtttgaagtcaggtagcgtgatgcctccagctttgttcttttggcttaggattgacttggcaatgcaggctcttttttggttccatatgaactttaaagtagttttttccagttctgtgaagaaagtcattggtagcttgatggggattgcattgaatctataaattactttgggcagtatggccattttcatgttattgattcttcctacccatgagcatggaatgttcttccatttgtttgtatcctcttttatttcattgagcagtggtttgtagttctccttgaagaggtccttcacatcccttgcaagttggattcctaggtattttattctctttgaaggaattgtgaatgggagttcactcatgatttggctctctgtctgttattggtgtataagaatgcttgtgattttcgcacattgattttttatcctgagactttgctgaagttgcttatcagcttgaggagattttggctgagacgatggggttttctagatatacaatcatgtcatctgcaaacagggacaatttgacttcctcttttcctaattgaatactatttatttccttctcctgcctgattgccgtggccagaacttccaacactatgttgaataggagtggtgagagagggcatccctgtcttgtgccagttttcaaagggaatgcttccaggttttgcccattcagtatgatattggctgtggttttgttatagatagctcttattattttgagatacatcccatcaatacctaatttattgagagtttttagcatgaaggttgttgaattttgtcaaaggccttttctgcatccgttgagattatcatatggtttttgtcgttggttctgtttatatgctggattatgtttattgatttgcgtatgttgaacaagccttgcatcccagggatgaagcccacttgatcatggtggataagccttttggtgtgctactggattcagtttgccagtattttattgaagatttttgcatcgatgttcgtcagggatattggtctaaaattctcttttttttgttgtgtctctgccaggctttggtatcaggatgattctggcctcataaaatgagttggggagaattccctctttttctattgaatggaatagtttcagaaggaatggtaccagctcctctttgtacctctggtagaattcggctgtgaatccatctggtcctggactttttttggttggtaagctattaattattgcctcaattttagagcctgttattgctttattcagagattcaacttcttcatggtttagtcttgagaggatgtatgtgtcgaggaatttatccatttcttctagattttctagtttatttgcatagaggtgtttatagtattctctgatggtagtttgtatttctgtgggattggtggtgatatccccttttaattttttattgtgtctatttgattcttctctcttttcttctttattaatcttgctagtggtctatcaattttgttgatcttttcaaaaaaccagctcctggattcattgatttttttggagggttttttgtgtctctatttccttcagttctgctctgatcttagttgtttcttgccttctgctagcttttgaatctgtttgctcttgcttctatagttcttttaattgtgatgttagggtgtcaattttagatctttgctcctttctcttgtgggcatttagtgctataaatttccctctacacactgctttgaatgtgtcccagagattctggtatgttgtgtctttgttgtctttggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgatttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatgagatgggattcctgaatacagcacactgatgggtcttgactctttatccaatttgccagtctgtgtcttttaattggagcatttagcccatttacatttaaggttaatatgttatgtgtgaatttgatcctgtcattatgatgttagctggttattttgctcattagttgatgaagtttcttcctagccttgatggtctttacaatttggcatgtttttgcagtggctggtagtggttgttcctttccatgtttagtgctttcttcaggaactcttttagggcaggcctggtggtgacaaaatctcttagcatttgcttttctgtaaagtattttatttctccttcacttatgaagcttagtttggctggatatgaaattctgggttgaaaattcttttctttaagaatgttgaatattggcccccactctcttctggcttgtagagtttctaccgagagatcagctgttagtctgatgggcttccctttgtgggtaacccgacctttctctctggctgcccttaacattttttccttcatttcaactttggcaaatccgacaattatgtgtcttggagttgctcttcttgaggagtatctttgtggcattctctgtatttcctgaatttgaatgttggcctgccttgctagattggggaagttctcctggataatatcctgcagagtgttttccaacttggttccattctgcccgtcactttcaggtactccaatcagaagtagatttggtcttttcacatagtcccatatttcttggaggctttgtttgtttctttttattctttttcctctaaacttcttgcttcttttcattcatttgatcttccatcactgataccctttcttccagttgatcgaatcggctactgaggcttgtgcattcgtcatgtagttctcgtgccttggttttcagctccgtcaggtcctttaaagacttctctgcgttggttattctagttagccatttgtctaattttttttcaaggtttttaacttctttgccatgggttcgaacttcctcctttagcttggagtagtttgatcatctgaagacttcttctctcaactcgtcaaagtcattctccatccagctttgttccattgctggtgaggagctgcattcctttggaggaggagaggcactctgatttttagagtttccagtttttctgctctgttttttcccatctttgtggttttatctacctttggtgtttgatgatggtgacgtacagatggggttttggtgtggatgtcctttctgtttgttagttttccttctaacagtcaggaccctcagctgcaggtctgttggagtttgctggaggtccactccagacgctgtttgcctgggtatcagcagcggaggctgcagaacggcgaatgttgctgaacagcaaatgttcctgcctgattgttcctctggaagcttcgtctcagaggggtacccagccgtgtgaggtgtcagtctgcccctactggggggtgcctcacagttaggctactcgggggtcagggacccacctgaggaggcagtctgtccattctcagatctcaaactggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgttttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatggtgatgggaggtactggtattacaaaaagcttctcccccgtgggtcaaatctaagctgagtgttgagacataattgaaattcactagatagataggagataggggtagggaattctaatcagagggaatagcacatgtaaggcaaacaatacagtgcatctgggaaagctatacaattttattgttataggacaaatgttggggaatgttgagagatggaactggagagtgaggcagaagttagcatttattcatttattcagcagacctttatctattacctacattgcactaagtactgtgtgagcattagagagaaaaagatgaatgagattggacaccattcgttcattcctgactatgaacttggcattgttctaggtaccagagatataataatgagaaacagacatgctccctcccctcattgaggttacagcttagtgtggagacacacagatgcctaacgcactatggtatggaaggtgctatggacacagtgctcaaatccatgatctacataggtatgagagtgacttttctacaacttaaatctgatcttgttattccctgcttaaaatcctgcagtagctcccagtagtgccttctggttaaaatacaagatatatagtatgacctctcaaggacctttgttatttgtctctggccacctctccaatttttcaccatgaccctggccctgtcccactggcattccatctccaatcacacggaactatgtggagttattaaaatgccctatgttatttcaagactcagagatttagtgcctcagcctgttttgttccctctcccctcctccacctggccttctccagctcactcatcaatctattagactcaggcatcatctgcttgccttcgtaaccctccccaccccgctcaccttgctggattctgtgcctttgcttgctggttcccagagatccctgcccttatttttctttgcctgctggatttgcagtgttgtgtcctatatggtgtagaaaaccagctcaggctcccacttctctgggcttatgtggtcagatgcagacctgtcttccatccataccaaaggccatcagggagtttcttttgtcctcttcaccagcccattcttaatctttctgataaattttctgcactgtgtgcgcgtgacaaattgggtcaaggtgatggtaatttacagcatgagatggtgaacttgctgcctgtgctgatgagcccattggatttcccctaactagtctgtttccctacccaggtggagaacttcagtagaggaagtggcaggaatttgggaatgaggagcacagtgattaaactggggccattcatatgagagtttaagaactcagaccagtgacttaggtgagtaaaaatatcagaaaaagggaaagaggataagagcaacttgggccataattaaacttgtcaatgaaatgaaggtctgttattctaatgcctacattttgccaaacctttgtgcttataacttcatcatttgctgtgattaacaaagttgaaagaataataactacttacaaggcccacatcacctccttataccactagcttttgctttccgtacagacatagctttaaaaagtgcaaatcctattctgtacctgagccacaaccctaaaagggaacttgtttacaattctaagaataatattgtcctttaaaggtgaaggctcgctggaaaacatgccattcatgtgataaaaagcaggtagcaggtagtgctaaagacttactagactgcatgtttgtgctttctgctgcattcctctaatctcaaggcagtataaggagataacatcttcacagccctttcagccctgttgcaatttctttgaccctggcctgatataaaaggcaaacttggtttttcactgttctagtcatgcagtttctttgtggttccctttagaaagacttgaggctatgagtcaaagcttttacgtcttgctgatagttcagagttgtgatgtgaagcaataaataaaatccctccttccacatacttgtctccttgattagaatcattctgggcaaatttagaggctcataaagtccatttagatatttagtgaaaaaacaccagcactcagaacagaatgttgataatgtagatggaatatctttctctctctgtctctgtgtgtgtgtgtgtgtgtgtgtgtgtgtatttatatatgtgtgtatttatattatatatgtgtatatttatatatgtgtgtgtatacatttatatgtgtatatgtatttatagtaaatatatcacatgtatttatatatagtaaaaaagaggggactataatatatctttatatgttagcatttattttaaaaagaaaacacaggaatatctaaaagaaactattacttataggggttatgggaaatgccatgggcaagaattttttttttttttatcaccatgctttctgaaacaacacgatatgtatcacctttataaaaataaaataaaataaaaaatgaaaaacaaagtccacttgtaaccacatgtcagtagcatgtttgctttcagggtacatcaaatgcattctatagcacaggatgttccagtcactctaacaaaagatgtcctgtttggaacaccaactctgtatcagttacttcagacactttctctcattgagtcccttcagcaagcccttttaggtttatgttcttagatgaggaaaccaagtcttagaaacattaactggccaaactaagatcagagagttagaaatgtcagagcccagaactggcatcttctgacttcagatcccatgtactttcccctacactgtgctgaccacacctccattactacagatgtgttgattacatctaggggccaaagtacacattcatccaataaatgcttactgaatgcttaccgtgttcagggcactgtggcaatcttttgtaatgcaagaaaaataagagtagtgaagacagtcaaggaaacaaagaagcctaatactaggcaagaagtgcttttgatggaattaagcacaatgagggtgttagtacagaaaggacatttaattgaactgggaaagttcatggcagttttcccagagatgagtcttgaaggacaaatggtatttagccaggaggaaagggggtcaagtgtattccagggagagggaacaacatgtacaaaagcacagttttgaaagaacactccatttttgaggaatagccaatagctgggcacgtctagagcatagggtagtagagagaaaggaggccggaaatgggaagagacttgaatgccacattcagttatgtggacttcatcttgtagcaatgggagcctacaaaattttaagtagaggaataaaaagattccatctaaaacttagaaaaattactttggcaggataagagacaatgaattgacggggagctgggtttgatagcaagaaactgtttgggagactgttctaattacatattttcttgtttttagatgcacatatacgtacttttttagctggtcatttctttctgaaattggaatgaatcttacaatcaatggcatgttataatttcattggcagcattatttgtctcttaagggcccccaaataatagtgtgtcacataactgatagcatctcaaattagatgaaatacagtagtccaggcaagaaatactgagatggtggggtggtaaagagggaaaagatttgagccacatttagatcctgatgtggtattaattattaagtaaaaaaaaggaatgtgcagtacatattcagtatgccacaagttgtggaaaaaaggtgtgcatggatagatgcacatgtatgtattcataaagttaatgtggatgcataaagcgtctctagaatgatacacaagaaacaaataacacccgtggcttttagtggggggcattgggtggctgagggagaacagcggtaggaaaatttttcattgtgttctattttgtacatttgatagtttgaactagtcgtattatgcacttcaaatatgtaaaaagataaaaagtaagagatatttagaaaggagcattgacacatttgttgacagattggttatgggataaaggcgatagtattttattgactatattttattcttttaattattcctctaatttcttaaaacaactttattgaggtataacttccacggtataatttcacccattttaagtgcatgaattcagtgatttttagtagagtcattgagtagtgtaaccattcctacaatggttatagcacatttttatcatcctaatgagatccttcatgctcatttatttaatctccattcccatctccatccccaggcaaccataatcttccatgtttttaaaatagctttgcctatttttggatgtttcatacaaatggaatcatacaaaaggtggtgttctgtgtctagcttctttcccttaggataatgttttctggtttataaatgttgcaaatgtcagtatgatacttcattcctttttatttgtgtctacaaaatactctattttatgtatataccaccttttgtttttctgttcatcagttgaagaacattgcagccgtttttgctttttgacttttatgaataatgctgttataaacgtttatgtttaagtctttgtgtggaagtattttttcatttccttgggtagacacctagaagtaggatgttgtatggaaaattaatgtttgactttttaagaaactgttttccaaagtggctgtaacagtttacacttctactaacaatgtatggaggttcccacttctccacatctttgcttacacttattattgcctgtctttttggcagacttaagcctagtggttgtgaagtggtacttcattgtgggtttgacttccattcccctaatgaccaatgatttcggacatctttcaagtgcttattaaccattcacgtgtcttctgtgatgaaatgtctatttgaatattttgcccaatttaaaactgggttgtttacctccctattcttgacttgttaggattctttgtatttttaactttaatttgactgaggataatgatccaccagtaaagagatgcatttatttctgtatttatgaaaatctttaaaattcctctacctttcagagacacccttcaacagactgcgcttcttattttcagagtatgtatttccatgataacacaagtatcaattataaatattaattacaactttccctcctcactgcagactcaaccaagagttataaatctgtgtattactttcaatgctcataacaatcttcttaaccaccataagcagactgaaaaagtcaatctagttgaattgttttactttataatgcttttataagatactcagtctgaaactgaaagataggtagctctagaaatgtgataaatggccacagaagtaacaacttttaataaattaaattatggatgttatgtcaattttaagtaatgtctcagttttatatcttgttacctgacctaaatatcattccctttagtaaaatatctattaaagctttgtggcaaaataagaacagaaaaatggtttttgattttcagctttctctggtgaataatttgttttcttttatttttccttctaaaataatcacacgtttcattgcaaccctaaccctcttcaacacacacacacacacacacacacacacacacacacatggcttctagattctacatgtacaagagtgcaaatcaaactaccatagaaaaactaagaagagaggcctagaagcaagaggctgatacactatctcaggcttcaacaaaatatttatctctgactataccaaggatgggcagagcttgcatgtaagtggcttgggctagcagactgggttttgaaggaggacaacatggccatgttcttggttcggtcatgaactgtctatggcacataccttaaatactgttggaaggatccgttagctccagagactgcaaccaactgcctatggtcataactcagctctcagacacattttgttgtgcccacagagtgctgtttgcctgtttggtttttaaaccaacacttaaaatgcagggaatttaagataaaaatttgataaaaatgggaagatttggccgtattgggctcatggtaactgagatgcatctgaatgacaggcattcctttgaattgcacatttgctcttgtttttactataggccactctcactttctgtttttttccccggctttgaaacgatcagttttagtactgaaaaattatctaggatactaaaaccagaatttctctgctagatggcttgctcattacattacctacatgattctgtgtaagggattgtgtaagttttctatggttgccataactatcacaaacttgatggctttataacaacagaaatgtatttacagtttggaggcagaaggtctaaaatcaagacttctgattttagtctgtccaagagcctctgctggtagggccatgctctcggcagaggctcttggggagaatctgttccttgcctcttccaccttctggtggcttcaggtgttttgtggcttgtggctgtatcactccaatttctgcctctgttttcgtatggccttctactctgctcctttagtctctcctttaggctgtttcttataagacactcacctaaaacccaaaaacaatctaaaagattttgcaaatatgaacattctaattaccttagagttaagattttcttttctgctaagtgagggcatggtgcagagagcaggaaagatgtgaaactagatagcatacaaaaataggtgttcatagatctgggcctaacaagggtgtggccagcaactctgccctgctttatcagcattagaaagccagtcctctcagaaagtgcccagttagctaaattcatgagattatagactattaaggtggaatggacctcagagatggtccttgctctcatctgaggcttcagttgggccagtcagaaatgtgggaaaattgaggcaggtcaaataaccaggagtacaaacaaacacaatctatccagaaaactagaaatcttactagtgactattcacaggttactttctgcattctggggttttcattctagaacagatgtgtgtgtgtgtgtgtgtgtgtgtgtgtgtgtgtgtgtgtgtgtgtggtgcgtgaagagaggggaggggtgcccagaaaaccatacccactttcccacatatcccaactatgactgggcaattatgtcattatcaccactgatatatagctggaagagtttagtgttgccctgctaagatctggattttcttttctggagcttggctattggggcattgagaagtccagccaggaggttggtcagaggctaacccaaaaagctttgcttaactctgggctacagctgggggttgccagagagaagtgcctggcattcctgcatgctgacatcaagcttcgaagttgctgccctctggtgagtcagcagcaaaggcccacatcgttcgagaatgctgcccaatcagaagatgtgatgccacacctcagaaatctttctaaacctcagcattctgtagacttcaaacaactcctcctgagaaagaatgtagaaataattaaatttataagattaaagttataaaaagcatagagcctataataataacagcaataagataaactccacatttgcttttaaaacaatttatttgagtagacagccaaccccctgtattgtactcctttaaaaaatattttaggctttttaaatgctgaggcaaggggacataccaaacactaacaggcacattggggttttctggctattgaaataaaaatgtccttacataacactgatgtactggaatagcactgcgttccagtgacggttattgcaactcagccagcatatctgtagcttgtgagcttttcttatcagaattttatctataaatatacatatacgtaaattctattgtgaaataaaaataaaatgtagaatcttctcatctttcttattagtcaatattgtgctactctttaataatttctctcaattttttcattaagcagatattactagggaaatatacatgaggcagaaggcaaattatttgcttagtgcaatgcaaacttgcttaacaggtaagagcagagtcccttccatagcattgccaccatatggcattgccatatcgtggaggccataaagaggaatgacattgtaaagattaactggattttacttggcaaggtcaggcacctagatggcatgctataaaatggttagaagtgcaaaggaaacctgtagctagaggccatgtgagattatggaagtgacttttcttacaatcctgccatctggtttggattgtcaggatcaaaacatttcacttgcccaagtgaggatgctctctacatggttttggggatgagggagactcagaaataatgtttgtggtactgtagcaccactaggaaaagagaaaaattggacctgacatgaagaaaagcatgcagccagccactaagactacttcccacaggactggaaatctctaccaccgtacctctcctacatgctgggtataagaagttaaagggaagccagattatatttacctactctttcattcattcattcactcattcatttattcatccatttaccatttgtttgttttttgttcatttacttatttaataaaaattgtgttttgcatattctaggtgccaggcattgaagaaccactgttattgttctcaaatgactgacagtttagaggagaaaatggaagaataaatagacacttgtgatgcaatataatagtgctctaataagagcaacatatattgaataccactgaatattaaataccagggactttgctaggagctataaattaatctccacagtacatctaagatagaagttttataattactctctttaggaggaaataggggtctatagaggttaagtctcacagcctggaaggagtcaacaaaaaaatactcagccttaggtattctgactagaagcttgggtccttaaccacctactcaccaatttgaagaaagatgattgaaactgcaacagctacactgactcttgaaagcaaagtaactcgttaaatgagggtatgtgtatactggctgggatattgtgggctcatgatgacttgtaggccgaggcagctgcacatatgaagactatggagggtatatcatcagcggaaatgaaagtgattagtgttggaggtttcagtgcatattctggttttctattactgcataacaaatcaccctaaaatttagtgacttaaataaacatgatcatttatttagctcatgaatttgcaagttgtgcagcacttgggtgggatagctcacctttcttccatgcagtgtctgctgggactgcatgattgcatgaagcggggctgggcagctagagctcttcatgaatctctatttttgcatgatattttcacaaggtctctcaagcatgggagcttcaggtagcagaacttctgacagggcagcttagtcctttgaaagtgtatgtctgaaaagagagactcaggcagatgctatattgccttttgtgaccaagccttggaaatcactagtctctcttgtgttgaggtggttataagagcctgtccaggttcagtagggagcataaatttcacctctgaatggagaagtgccaatgtcctgaaaaagcatgtgggcccagaaatactgttgtggcaattttttgaaaatcaagtgtgataaagacagcatagtgtagtcataaaaaacagattaggagcatgatgtgctttgatttcaactatgggctttattacttactaactgggttactttggttaagttgtttgactcttgttttttgagatggagtcagtctgggagactccagctctgtcgcccaggccggagtgcaatggcacgatcttggctcactgcaacctctgcctcccggatacaagcgattctcatgccttagcctcccgagtagctgggattacaggcacctgccaccacatctggataatttttgtactttttttctttttcgagaccgtgtctcactctgtcacccaggctggagtgcagtggcatgaactcggctcactgcaacttccacctcctgggttcaagccattctcctgcctcagcctcctgagtagctgggagtacaggcacacgccaccatgccaggttaatttttgtattcttagtaaagatagggtttcagcatgttggccaggttggtctcaaactcttgacctcatgatccgcccgcctcagcctctcaaagtgctgggattacaggcatgagccactgtgcccggcctaatttttgtatttttagtagagacaggattacaccatgttgaccaggctggtctggaactcctgacctcaggtgatctgcccaccttggcttcccaaagtgctcggattataggcatgcgctaccgtgcccagcccaagttgtctgactcttaattctcagctttcttatttgtaaaatgaaggtactagtactaatttggagagttgttaaagattaaataatatatgtaaatgccttggcataagggactggcacaaagtaggcacttcatatataaaagctgtgattattgatgaaccagtagtgaggtacataactggggaaggagaaggggccagtttgtgggaatgcttttttagttattaatagtaaggtggtaaaataataatagtaataataaccaaaagttactgaaaactaaatacagtgctaaactctttaaaaggagtatctaattggatcttaacaacaaagctatgaagcaggactaatgttatctcattttataaatgaggaaatgtaagatcaaacaggttaagaaactttcccaagttgatcagtagcaaagacaggattcgaaccaaggtaattgtcctatcagaaactgtactaggatagtctgcatttcatggtaaagactatcagatgccactaaaactttttaaaaagggaagtcttgtggtcaaatttgctctttagaaggcagtatggagtgcagatcagatgctggcagcagggagatcagttagaagatggttgctctaattcagttgagaaatactgagacatctgaaatattgaagacatcagtagtgtgggtgatgtgaaagtggttctaagaaactagcggcaatcatccttcattactgattgggcgtggagagaaagagaggtagcattggtagccgttagtcaactctgagtgcaggcactggcatgtgcattattacccagggctctaagtggagaaagaaaacaaccccagggtgtcttcaaacctaaagcatatttcctaagcctttgcactctcagtctagactaaaaacaaacaaagcagcctcctctgaaatgctggaaactttccccacttgaaactctcagatctcttaccttgcaattctagctttcaaattccaagctgagcttcctttcccacaccccgagtccttgtactggggattacaatgatcatttgtatgtactaggtgattgttccttccacatcaggggccttggagcggatgacctaaagctgctttctcctgtcctgactttctccacccagcactgcaaccatacatacaattttctggtcttgtagagaatgactgactggtcattatagtcttccaaaaggataagagattagtgtcatgatgtggccttcaggcagccagggggaatctccatatgaggtacttgttgactgtattacttagttttaggtgaacttcctgtggagggacaatatgtgcttagaaggacagagaaggaatgtattaggtaaggcattctacatctcagataaagaacttcaatgaattgttgggtcaaggtctaagaaacaaaccagccgtcaatgggaaagttaactaaaatgaagaacccaacatacaaccccaaatcctagtttttctgactatgttttcttaaactgaaataatttctgagattaaaaagaagttgctgtgactttgtctgatagatgtatttttttgttatatattagtttgggccttctatctctcctactttgttttctttataatagaattaatctctgaaaagtaactttactgtattctgatgctccattttgaataagtcagttcttctccgaatgggctctggagattggcatttgattgaacagcttttgtgtattgattgttttaggtagactgggtactccatttaacttagtatttctgacaataaatcagtcgagaagggagtattactctaacggtttgaacacttgtctatgcacattgcttggtcattcaataagtagttattggtgagatcgggcacgttcagggtggtatggccatagacaataaatggttacgactctgccttcagctgtaccagtatttaagttataaggtagttaagttacaccagtgcaaaatcatacagtttggtcacagtcctacttgaggatctcaaacctagctccccttaacaaacatggaggcttaatcttggctttgcacactgaattattcctttagaaaaatacttggtgtacaactcatccttttcatttacaaagaaacaaatttgagcagtttcacaatttaaaaagtctcccaaatggattatatttaattgtccatttccaatgaaactcactaaattggtaaatagcagtgagtgaataactgatgaggtcatactttcttgttttggactactacaaacaccacggagcaacaacagattagaatataaaggttaagcaagggtttagtttttgttcaaaagccgttttgcttgttacaaaggctaccaaacctttgaacatcagaccaaaccaaaaacaaaacaaaacaaaataaaaaaaaccccaaaactgaaagatgaaaacatagtttgataatctaagctgctcttcctttatttaaccttgaatttatgagattatttttttccccagaagaaaaattctcttagggacactttcagcaatttaacattttctaagcattacagcaaataagaggcgatcatcattcttcagtcataaagataagccaaggaatgaaagtgttttgcaggtcatgtcacctgacagaaactttggactggtcctttcctggttcaagagttcagccataatacctactttccctatcagctggctcaagctgataaggtcctgaagcaagcaaagcttctttatgagcttttatttaattgtccttgccacataagggttgaggggattcgtctgtacagagttacttcttgttggtctattttttctttggaataaatcgctgtctcccctgactggatagagtaaatagagtttgtttaaacacttttcatcaaattcctagtgcctagtacagagcttttaaccctaatacgtttcctgcgtgtacttattgaaggaataatgacaaactctgccttagattggtgactggctagggagaaacatggttcaagagctgaataagtaagagcaagtattttattgtatgcccatcaaatgtattcgatgctggtgatggaggtaagagtgtgatagaggctgagttctctgaaattacatatgagatgtcatctgccatttagtattagctgtgtctgtcttttttccaggaatttggccttaaaagagatcattcaaaagtattacccaaatagtgatttatcaggctttattgtggggaacctaaagtggattgcaactgctatggtccctttgaagggagctggtgcaagattttccatgcctaatcacactcattttcccttgctctcccaatgacctcccatctttccttctatttggtctgataaacaccaacaataggatcctttctgcagcttccatcctaacttgtattctagccttaacactgcaacaaactcactgttacctagaagtcaattgacttccctgaatgttagcttctttagctgtaaataagtaattgtatgaggtgatggttaaggtgatttactaattttacaattctattattttatgaatagaccctagttaggatagtttgaaatagatacttaatccactattattctctcttctaagatatagttactagttgatcatacttttccttaaaggctgaactgaattctctgatatcagcaactaaacatctcatatttgtcagtatgaacatccactgggtgcctgttatttaaccaggtagaattcttagctgtgattgaaaatctaggtatctcttctggtactatcacttggatgagtaaagtttgaaaaccattaagttgacatttctaataggactgtggatttaacatagattcccagaagtcttggaatacaacagtgtacacagatgaagatacagtactttttggtattttctttttgcaagtgttacaaatatctgcatgtcataacatcatcactatggatcccatcttttaatgagagcttagtatatgctacacactgtcactaaacatgtaggatcttgtttagttttctcaaaatgttgtagttactatgattattttttgtgtcttgcaatcattgtgtataagtgcgtaaaccatgtatctagagtttatagaagaattaaaattcaaaaaccctatactcatctctcatttttaaaaaataccattttacctgtctttagatgccctgtatttcctccccaatctcatcccgctcctactcttgaaagtgatcactatccaaattttgtgccaaacattaacttgttttctttagctttgccatctatgtatgtatccctaggtaatacatggcttagttacacttgtttttaaatttgatgtaaatgtaatcctatagtatgaattttctaagacttgattaatctatgaacattttattttgagattcatcaatattgatgtgtgtagctatagtttattcattgctgttgctgaaaaatattctattggatgactttgctacaatttattctaccattgttggatatttgagttgttcccattttatttatttattttatttttttgctgttatgaacaatgtggctttgaacattcttatactacctggcgtgtatatgtatgtatctgtctgtctgttcatcttaagatgcactacaaaactgaggcctagagtcaccaagcaacttgtttaatgtcagagtgagttggtggtgaggccaaagtctgaattcagcagtctgttaccatagttttcatccttaaccacaatactctatgaatccttattttaaaaaggaaggtctggagaatttaaaataacttcctaaagagcagggattcaacaaagctcagtctgactaatgccttccatttttaaaaaatcacccaaagcacatattatgattctatttgtgaagtattagctaattacaagagaatgagttcatacttggcactactatctctttcttacaagtgatcagatgtcaaaatgtgaaaactatacatttcacattatccatatatatgtgacatttttcctttaggaatatgagtagaaatagaaagacaggtttttacagtgaaatagattttttttctctctctttagcctaccaaatctctttcgcaatacctaacacttataaatgcatttaatttcagtgccaattaaagaaattcgaaagtagataataagtgagacaagcacccagtaaatgtttatgatgtgacactgacaaattatgggctgctataatcaagatagcattaaaaattttaaagtgtttgtatgaacaaaccattttggaaggagtgtttggtgtggcagtgagcaaaacaacccagtaactatggcagttagtgttaaagctctgattttgacatgaaaggaataaaaatggaagtccagctaaatcacaagtgtcctggagaaacttggatgagtttcttggctagaggtttttcccaccacagtaagtattttcaaaggaaaacaaagtaaaatttttctcttgtatgagtcacatctctgttggttgtaagtggctgaaactcatcttgaactaccaaggtaagagaagaaacatactggttaatggaattccagaaaggactgaacaatcaaaccattttgaaggacagcatagagctggactctagaacagccaaaacaaggggttaaaccactgcgagggatctctctccaactcttgctcaggcttttctccctggcttgactttcttctctttcactgtagattggcttctctcacatggcaagaaacattgctgctagcacttcccgagttctacgttctacaacatccaccactggtgagagattaacttatggtttttctgttgaaaagtcaaaaattacctgggaaaagtctgattgtctcagattggagatgttgcccatctctggaccaatacactattatgtgtggctgactatataaaaacatggatattttcttggaatcacttggtttgactgggagaagaccattctcaaaacaaaggaagtgcaatttatagaaggtagtagaataggcagataaaacaataattcttcactatattgctcaaataatccccatgacatttttagtatattataaagagagttctaaagtgtttccaaactattatagcaaaatttaatcttataataatttcttcttgaactatgtataatttacctgaaatattttccaaaaagcaatcaatgtgagaaaatgagagccctgtcttcttaaaaaaatgagtaaaagtccacaagttcagaacaaaagaaaatgaggtaaggcctaaaataaattgtgctaagaaagctaaaattctagacaaagtcacatcggcaaaactagaaggttggtactgtgcttcagtttactgcttgctgtttggttaagaggaggggtgatgtgataaaaatagtgacgaagtgagaaaactgacgtattagttttctattgcattataacaagtcaccacaaacttagaggtttgaaataacgcccatgtattatctcgcagttcctgtgtgtcagacctccaggcactgcgtggctcggctgggttctctgcttagaatctcacaggtcaaaatcaaagtatcaatgggagctgcagttctcccaagctggagcctgtgtcccttttaaactctcaggctgctggcataatttatttccttatcaagccatccatatgatcccctccatcttcaggccagcaatggcctgtcaaatccttctcattctttgaaaatctctgacttccctttctgtcacagctctgtaacttcttttctcttctgccaccagcagaagaggcttttaagagtttatgggattagattacatccgtctggataatcttttacttaaaggtcaactatgctatataacatagccaatcacattcgcacattgcagagactagggtataaaatcttcggggtcattcctagaaattctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattggggatacgaagctctacacacttgaagatggtgaaggaatataaaaatgtaagtattgcttttataataaatgtgttcctattggctgaaaatttcaatatctgatacaaatagtcaactttctattttactttttctaattatgcaagaccttgtaatcacaaatgtaaaaattgcaagccacatgcccctaaggccaaataaaaatttgtaaaattctcttaaaaagactctatagagtccaaatgaaaatacgtcgagtccttttaaaaggatccaaccacatatatcaactgatatacatggtaccaaaaacaatggaatcttttcagattctctaattggcctttggaacttatgtagcatcaggtatgcaaatgaacaacttcagaccttgattactccaacctcctctcccactgtcacagccacttctgtcatgacctagttgttctcagaaagttccctcttatacctggtcaaacttctcttacaatcacctgtgactttccctcttggtcttggatcaaatcatcctaaatacattaaaagtcctgattcttcctgtcccttaaatatatctctacttgaatcactgtgttagttcaggtcctctgagagaaagatgttaagatgaaattagatgtgcaagagattcgccgaggtaaaccttgtgggagaaaatggagaggtacatagaggagcctgggcagactgtgtggctactatgtaagactcatccccatgaaggagaaaggagaggaaggcaaagaagaaaaaccttaagatttcaattctaagaacgttttgacaaagctgattaggagtatttaaggcaaagctgcccaccagaagagtactgcatctttcaggaacggacttgctttagtacatctgctgtgcttagtaattggctgggagcagccatagaaagcatggactcagtacaaacttggtgatgaatttcagaggcagcggctaagaccatcagtctattattttccttgcaatagctgtcataattactatcagagcaaacaattttttgtgtgtgaattcatgagataatggtcttttctttcctgctttcaagagccatgtcattgaaagagctaatcattcaaatttatgctgcattactgactaaatactttcatttatcatactttattttaaaatactttaactcatggcccgatgattttcagttaaccaaattctcccttactatcctggttgccccttctgtcttttccttagaaatgttattgtagtatttgcaagatggcctgaatcctgaaccccccatcttcaatgagcaccaaatggtaattatagattcccagctgtagagctatgtcagacaaaggaaacttcattagtatgtaccaatgtttggactccaaatgcttttgtgtctgagtcacaaggactcctcttccttggtggcttaaagttaggctgaagaagatttacattatgttgtgcatgacctctttagtttggttctacttatactttcaaggagggaagactggggaaggtgtcccttagtgagcatattttgtacaaatgaaaacagggtactaacacttatgccaggacgcatgcataaactaggatggttctgagaaaactgcgatatatgatcactccagggtctcccctctcagaagcgagggagacttaaaccttttacatcaccaagtacatggaaagaaagacagcagggaagtgattccgaagagaaacctgaaaaaagcaatgtggaaagatagacactttagccttttctttcttctcaaaacttcacattccttttcactctgcttcacttaagctgccctagttccagagtgtttcctctcttgggtgaagatgggaacaagtacatggggtagcaaggggtgggtgggacctgtgctcccattaaggttcttccagaatcatttctatgtgattatcagcttggatcacatggacttggggattattggtggttttctagggtaaacagggcatattgtgctggaggacatattttatatgtaacaatttggggaaattttcttttatattaaataaaactgagatatgtaatgaattaggatgaaaaattcatattcatctgaattttataagtgaatcatgagaactcaaagatacttagcccttgggaccattttttactcctgttcggatcccttcagctaagcatgattatttactattttcagctattagttatgtcttgttgaaaaagtatgaaaagagctgcccaataaattagagtgtatgctcaacattctcttagcttctttatctctttccaaaattggatcaaatgacattggacatgatcaacttcttactgttttgacaaacatctgaggatacttttataattgataatttggactagattatgcaatgtgtgatgagacacaaggtagtctgtactccccatgatatgtatatctgtttgatatactcaaacggtgtatatcaaacggatataagtttgagtaggtatggagatgagccagggtttatttcttcaactagtatttactgaatggtcttatgtgccacaactgttctggaaactgtgatacattaattaacagataaagcctttccctcacaatgcataacagacccaacagagtatgaatgtacatacaaactagtaaataagaaaacaaataaaagtattcagatagtgctataactactgggatgaaaatcgagcaggaaggaaaatatagcctgcttgatgtggaagacagggatagcctctctgaggaggtgacatttgacccaagacctaaatgaggagaaggagacagtgagatgaaaatgagggaaacagcaatggcaaatacagagaacttgagacaacttggcccattggagggacagagacaaagccaatgtgggaccacaggggatgaaagggaggctgattggagaaataggcagtgctgaggccataaaaggtcctataggtcatggaaagacatttggttaccattctaatgacagtgagatgttactggggagttttaaactggagaatgtcataactgtccagatgtaaccaaatagtaaaaccattcttcctgaataacttggctaaaaggaatattatgactacagatgtacatgaagattaagcagaacatggaagaaaggcctcaagtaaacttgacctcacataaatatgggaggaagatcaaatggaagctgggagtgttgaaagaatgtaaggggaatgacttctaataatgaacaaaaagctgttattttattatgaagaaaaatgttatgcatcttatgcatgcagaagaaattcccattcaaaagacttggaaaatgtcttgggtgtttactataataaaccttttaagatatagaaaattcacatatttagagcttaatttctaaagagctcagacttctcagtttattatatgctatgaaattttgtttatttttaatttaacctacttgtgtgcaaaatcaataaggaagcttaaggaatataaacaactatttaacatggccatttaaatagattcaaagtaaagaatatcagcatagtgtttctttgatatgacaacccctcctcccagggcacttaaatgaagggttgggggggaatcttaacctgaaattgaaaaccctgaaatcatgtttccaaggaaggagaaggaaaataggaaaaacaaaaacaaaaagcagcaactcatttggaagctcgtgggagaggagaggaggattcatacatctcggactggtttgccttagcaagtgaatcatttaaataggaaaaaacagggggctgactcagcttgagcaaactcttgctatcccctgctgaggtccgcacttgctgtggcccctgccgctctcctcggaccttgctgccctcctcctttgtcactgtggagaaacaggaaggaatgtttattagcaagactgactggggtcacacccaaggcaatatcaggtttttacctctcccaggcctgggaagaggttcaaggatcaaggacaagctcccggttagagtgagaggcaagttcaaacctttgaaaaataaactcacaaccagcatttggcacaggcctctggagtttacagaatgtatctgcctgtgtgtgatttcattagttcctcctgccaatctaatgagattttacgtcctgtaacagtgaggcaattggagtctcagcagggaaaggaacttgcctaaaactgcaggatgggtagcgcttggatcctgactttctgactcctaggactgtgctgtcttcagatgatcacatgccttcttggcagatgtttctaacaaaggagagagttgcccagggtggggctctgctagctcccttgtcatgagccattctctccacattgccttttagttgcaccacatagtcaccttcaattagctgtgcgaataggctcactcttatgctaacatgtactaaaagtgaaaatggggagagagagagagagagagaaagagagacacacagagagagagactcatattatggtatgttccctgccccaccccactccactccctctcaacagggagaaagtacctgaagaaaatcattgctatgaagggcatagccagctaaatgggtgtcacttagtctgaaaaatctcaaagatgtcaataagccactcgagacaacaaggaacctgttttcctgtcatcattccttctcagtccttggctttgggaagggtaactttatggagagagaagaacctctgtggagttaaaaggtttatgaacttttttccctgcaacaaatcagtgacagctgttccacaggctgatggttttccctttacctttcgttttttaacagctatgtctcacagtccagacttggagtacaagtaataagaagaataaaacttaatcccttaagtagattcaccataagttagctcagagcaattccagtgcaagtatggtctgtgatccagtaggtgagtgactctgctgctgaaattcacatgtatgtgaatttcacagtggcctttgctttgtagcatgctgtaatccttttgtccattttcatcacacgaactgctgaatataggattgttaaatggatggggagatatcatgaaaatgattaaagaagaaagttcttatttaggggtgcatacctgcctatctgaccattgtacttaggcaatcgggatcttgctttaagaaaaggtaggcattggagtcaggctgctggagtatgaatcactatgctatcatttttcatttgtttttgctctgttacattaggaaagttatgtagaattttgtgcctcagtttcctcattcaatatgggtgtaataactgtgcctgtcttgtaggattattgtgaggcccaagtgcaataatatatagtacactgtgtctggcatctagtaagcattcattaagatgacatgaagataacacagatatatcttaacatgtaattatgattttgcttattcaaggccaagcattccaatttaatggagttaggcaaacacagtaaattcattgctctttcctttttatgctacttcctttgaagaggcagtcaagttccatttgactgattcggaactttttagcaatgtatattatgctgacttcactcttatgcgctcttggggctataattcatcaagttaggcgagcaaagaagtgtgttggtgaaagagaaatgaggaagaacaaggaagaaaaaaagggtcatgagcttattcactgccaatatttattatatggaacaatgaccatccttcagaagtgtttgttctctattatactgtaggtgtggaagaattatcattgctcaatagctgtctcagtcactacctgatagacttgggaggtctggctatttcagggcgcatttgacatacagtgacatttttggattaaagctttcatgatgagtgccagtctgggtccaaaagggttgaaagctgtcgccatctataggctagttgtttgtagtaaaatactttccctcactgcattaggttcttggtaccatttatctagcagagttcttcagtgggcttgaggcttagcagtcaagttaaaacaataaccaacatcccaaacccagtggctgtcaaatttcagtgaggtggcatagaactttagcatgaacttgagcttgggttcagctagactttcatataaatccttgtttgaagttagtagctgtgtgatcttgggcactgatattaaacctttatgagaaagttatgtctgaaatatgggaaataaaccttccacttaggttgttgtgaagattcaatgagttgtaacgattgtatacactataatgatctatattacagttgtttcataaatatgattgccttcattttattctttccttgtctcgttcttcccagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagtaagtgctttgtaaaatgtcaggggctccaggattatatggtattactgtcactattgtaagcacttctaccttttttttctccttttacaggttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatccccatgttacatatgaagagacagaagcataaagaagttgcaccgctggtaattggctgggatttgaacttaagcagtctaaccttagagtaatgattttaacaactatgctatatacatacaaatttacaaaataaaactgggctcagacaataa

SEQ ID NO: 1117 - DNA, 337647 bp, Homo sapiens
gttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccaggtgcggaatataatctcgtggtgcgccgttttttaagcccgtcggaaaagcgcagtattcgggtgggagtgacccgattttctaggtgccgtctgtcacccctttctttgactcggaaagggaactccctgaccccttgcgcttcccaggtgaggcaatgcctcgccctgcttcggctcgcgcacggtgcatgcacccactgacctgcgcccactgtctggcactccctagtgagatgaactcggtatctcagatggaaatgcagaaatcaccgtcttctccatcgctcacgctgggagctgtagaccggagctgttcctattcggccatctttgctcctccctgcaactaactccattcttaattggtaggtgattcttatgggttgaattgttttcccccaaattcctatgctgaagttccaacccctagtacctcagaatgtgactgtatttggaaatagggcctttaaagaggtgattaagtgacagggtgtggtggctcacgcctagcactttgggaggctgaggtgggtgattgcctgagctcaggagttctagaccagcctagccagcatggcaaaaccccatttctactaaaaattcaaaaaattagctggctgtggtggtgtgcgcctgtagtcccagctacttggcaggctgaggaaggataatcacttaaacctggggggcggaggtttcagtgagccaagatggcaccactgccctccagcctagggaacagagtgagactctgctcccctccccccgccccacacaaaaaaatttaaaaagaaagttagcctggcatggtggtgtgtgcctgtagttccagctaattcggaggctgaggcatgagaatcgcctgaacatgggaggaggaggttgcagtgagtcaagatggcgccactgcactccagcctgagtgacagagtgactccatctaaaaaaaaagagaaagaaaggagaaagaaagaaagaaagacagacagacagaaagaaaaagaggtgattaagatataagaagaggaagtttggccaaagagacacccaggatgtatgcacatagaggaaagatcatgggaggatatggtgagaaagtggtcatctgcatgtcaaggagctaggcctcgggagaaagcaggcctgctaacactttgatgttggatttccctgcatccagagctggaagaaaataaatttctgttgtctaagtcacccaacctgtgatactttgttatggcagctgtagcaaactaatgtagtaatagtcattgaaagattttatgcagggaagcagtcattttgatggcattgtgaaagcattggaaagcagtgagatgcaggtgggcagatcagttaggatattgcatcagtctaggcaagagatgggaagggcttgactaaggcagtgaccatcggagtggtgcaatgagatatgagagatagctcagaggtaaaaattaatggagagagagtggataagttggcaacattttccaggtttcttgctcaagtggctgggtgaataatatgccatcaaggcctgaagtaagaaatataggaagataattcagttttgttttcaagataatgagtttggttttttgagatgttttcttggagtacctgtgggacatccttatggacaggttcagtggtagctaaatatccagatgtggagacgaggagataagagaggctacagacaataacttgtgagccatcagcaataataacagcaataatagtagttatggttaacacttaacctagggcttatcaggcgccaagcaatattctgaaccctttggatgtcacatatccttacaatgacctatggtgtagaaactactgttattcccattttaaagatgaggaaattgaggcagagaaaaaatacccaaagttactctcagccaggaagtgtagagtcaggctatgagcccatacagtctggttttagggcatgtatcttgacaaggtgatttgcctcttcatgtagttggtagttaaaattatggaaaaatattcagatcccttagaaagaagatttctatagggtgagaagaaaagaagtcagtataaaatctgaggacatttcaataccaatatgtagagatcagcagaaaaagaagatccgaagagacagcaacagtttggttagaatgatggaaggaagaccaagatgagaagtggccaacagtatcaatgccacagagataccaagtaacagactcagaaaagtgttcactggatgtgaaaagtaggagaaagctggtagccccagcaagggtcattttatttgggtttgagggagaaggatcagaagtcagatcatagtgactggagaagttagaaaaagagcatacagaaataaaagaagaattatggcagagaaggatatgagaggcagacagtcaaagagaaagagagagagagagagcaatttgggcaaaaattatggggacattccatgacaagactgtgattaaaatggagtggttgaacatgttcatagaccacgggaaaggagtcagcagaagaggggaggtttaagacagagaggaataatttgagaagggatgttttagagaaattagagaagtagaattaagagcacagctggagagctaaggaggctgtggagatgtttggcaatggcaactgaaaatgatggcattcactctgatgttcttggtcttctctgagaagtacggaagcaaagttatctgaaaaatgtggtagaggagaatgggttgggagacaaccaaagactagtaaaaggactgagaagtagcatgaagggctcaatagacaggagaaacattgaaattgtagtgtcagcaccacttaaagatgtatgatagtctccaatgtgctgagttctgtaggaggaagagtagacaacatgtattataagattgtctcaagactgggttttgcagcaggctgtgatagaaaaacctgacttggttgtgaggagtggggaaagggaggtgttaaaaatgagggaatttaaatggttgggaggcagttgttcacttgatgggccaaggagcacagactaggcaggtaattaaagtctaagagggaactgttaaactgagatattctcagtgtccttctttttctcactatctctcttcctactgttttacattttgtcacactgggaaaaagaggtcaatatttagaaaatcagccattgtgtctaattttcatattgctaaacataggatacattgagtacatattgctgcaagccctatggaagttaattcagtaataccagattacaaaggcatttacacttagactcagaaattctacttctgtcactttatcctacagatatacttaggcaggtacaaaatgatgtgggcaaaagcaccactgttattagtaaaagcttggaaacctctgaaatggccatcaaaaaatgctgctgtaaaagaaagaatgaggaaattctttatatattgacatgaaaagataaccaagattaagtgaaaaaaaggcaaggtacaaaacagtggtagagtatgcaccttttgtctatgaaaaatggggaattatgaatatgtatgatatttgccttagttgcacaaagaactactgaaaatatctacaagtagtggatgggacatgatttcacagtaaactttttatattgtttttattttttaaatgtggctgtgttgctaaacataaagtggaaatatatgtgtgtgtgtgtgcatatatgtgtgtgtgtgtgtgtataattacaagctacattgtgatagccatggagatgcacagtccagatcccattacaaggaattaattactgcccagctgtggagaacgtagtctgcacaaaagcctccagctgtcagctcctttagggtcagcctcgggggtaaagagccatcttagccaaagtcatgcccttcccaaggcagcttacatttggtgactgagagaagcaagggaataaagactgggacattttagtctgggacaactccgaagggcaatattagcctcctaagctcccagccagggtgactggggactttgtccagcctgcatctggtttcagcttttttcctgctcaattctgcttcctctccccactccccaacacgtttgacagatatttatacctttttatttctatttttaaatttttttttttagaggtgggggtctcattatattgcccaggctggtcttgaacacctgggctccctgccttggtctcccaaagtgctaggattacaggcgtgagccacggcacccagccagatatttatccctgataaacgtcttgcaacccaaactttggctcagagcctgcttttggaagagtcaggaatatattttgataacattctaaagatttagttttcaatgcatagtatacttaatagaaaaatcaagacatttaaacttaaaggaataattcaaataacataatagaaaattatttgtatccagttgtcttgagtctaatgtatttcaatataaccttttaaagttacagttttaacagtaacacttataatgtatcttattctcagtaaacaaactataaaacaaaaggttttttacttctgataatatcaaggaacagtggctatgtttgcaaattaaattaggctgggtgtgatagcttcatgcctgtaatcccagctctttgagaggctgaggtgggaggattgcttaaagttaggagtttgagaccagcctgggcaacatagtgagactgcctctacaaaaaaataaaaaacaaaaaattagtcagacatggtggcacatgtctgtattcctgagctcaggagtttgaggttacagtgagctgtgatcatgcactgcactccagcctgagtgacagggaaagaccctgtctgaaaaaacaagcaagcaaacaaataaataatataaaaaattaagaggcactcttttccttaacgaaatatttctatcagcggtccatattacctactacatgtatgcatgtgtgcatgaacacacacacacacacacacacacacacacacatacacacagtttatgactatgtttgcaatcttccaatctatcatctatccttaatcacttaatagacattttattaaatgctatgcatcaaaaacaattctaagacatgggccctcttttcaaagaattcaatatagttgccacttcaataatggtaccagaatgcttttaaaattcttgtgtgaggaaaacaatacgtaacctcaagcctgagactgcttcacgtatcacagtattttctgaaagactttccttttcagacttctgcattttccatttctctaaaacacattttctgtaaaaaccatctcaagtatccttacaaagtgtactttatatgatattttctcccaatcttcatacttgaacaaataaacatgtagggattatgtttctttctattctttattaatgtcatgaagtaaatcactagtggatgatgtcttttaaacttgttttcccagttacctattttgtgttgttattttgtcttaatgagatccactgagacagtaaatttcaaagcacttttccaacagtgaagtgaaaatatcagcattgttgtttttattaattattaatgaaatgaatgtattaactctgttttctcctcaagattctgcagaaaatctaattttaaaagttctatatttaaataacatatgttttccttttaaaaagttctatatttctagacccatatataaataaaaaatagtttatagtattaaatttatatctatttgtgagacaaggttgactaagtgatctgacatattgactaagtgatctgacatctagtatgaccatagaaacacctactttattaaaagaggtaaaaagtaatagttcaattaatactgattctatttaatggttcaacaaatcagacctcaattagaaagagctattcatttctcagtgcatattatctactaagcattttaagggctccaaaaacaagtagggcttcatcagtctttctgaagagtttataagtttataatatattcaagaggaataaggcaaataagcaggaagggagagataaatcccataaagaaggaaccttatagtggagagcttcaaatgccagagtgatttcttttcttttcttttcttttctttcctttctttttttttttttttctcatggagatgaggtctcgctttgttgaccaggctggtttcaaactcctggcctcaagcaatcctcctgacttagcatcccaatgtgctgggattacaggcgtgagccattgtgcccggcccagggtgatatcttaataatggtgatggtttcaagagtttatacatgtgtcaaagcttattaaattgtatactttaaatacataaagtttaatgtatgtcatatttacctcaataaaactatttttcaaaataccagtttttggtattttgaaatgttatacatagtggaaaacactgcatttttttaaacagagaaatgataaaactagtattctgccttatgacgaataagttggtggtaacattagttgacttaattaaaaaaggaaaatgataaaccagggtagagtactccagtatgggggtattctgctagattaagtaggcatgttgattgttaatggcttaatagagctagagttactggcttagagactgctaaagaaaaagaaaaaccttgcttgaagttttattaagactgagtcccaagagatctaaagacctagaataattgtataggtttccaagtcttatagaagagtatgatagtgatgatagtgaaaaatataaataccttctaatttgcaaagccttttctgggaggcagtgactcccagaaaatgtaaatactacatttacactgcttaggacaataaagcccaactctttatcttttgtaactaatgaatgacgaatcagctaattcatctctttatctcattctataataaaaagattagtgatttcagttcagtcacttcctcagaattgtggtctgtattgtgtcaggacaagatcaaataagtgcatatccaccttttatatgtctatacaattatttgattctagaaatatgagagtaaaaggaaaagagtaaatatgttggtgaaaagtgtgacagcacaagcctaagcaggagaacaaaatgaaaagtagttcttaaagggaataaaagttctttggatgtttgcttttcccgggttttaatctcttgttacccagaatataattgaaatatattattttaatggctgggcacggtggctcacgcctgtaagcccagcactttgggagggcaagacaggcggattgcctgaggtcaggagtttgagaccagcctggccaacatggtgaaaccctgtctctactaaaaatacaaaaattatatattttataattatatatatatattttagacggagtctcgctctgtcaccgaggttggagtgcaatggcgtggtctcagctcactgcaacctccgccttccaggttcaagtgattctcctgcctcagcctcccgagtagctgggataacaggcacccgccaccacgcccagctaatttttgtatctctatctctggttgtcactagagatctggaatcaggtgtgggaaaggatgggtcagaagactgctggcttttgtttgcttgtttgttcatttgttgttaaaaattctgtagtactatctcattgtttaaactatttacccatattattatgcattctataaagtgattatttggtgaagaccataaatattacatatagcatgaataaaaaaataactggctgggtgcagtgtcttgccctgtaatcccagcactttgggaggctgaggtggaagattgcttgagctcagaagttcgagaccaacctgggcaacacgacaaaatcccatctctactaaaaaatacgaaaacagctggaagtggtggtgcatgcttgtagtcccacctacttgggaggctgaggcaggaggatcaattgagcccaggaggcagaggttgcagtgagtcgaaatcactcccctgcactcaagcctgggtgagagtgagaccctatctcaaaacaaacaaacaaacaaaaactgtcttactcttactcagataggtacttatgatttggaatgaagtttccaattagagcttctatacggatttattatatacttaaccttaggcaatttagatggaagagaagagggtgttttctagaaaattatggtgatggtttaaaatgtggttccagtggtggcaacaatactgatgttggaggtgtctgcgaagagtttgattaaaattgtttaatgtatatgagtgggaaaagcacatcaattggggaacattctacaatattagacaatatgaaattgtaaacatgtatgtgtaaataaatccataaattattttttgactatgtctttgatattcctgaaatatgaaatattctagttggcaaaaacaaacaaacaaaaaaacccacaaaaactacttttgcatcttttcattaggaaaaaagcgattgatttaaatttgaagtcactttgtattttggcaaatttcacagtttcctccattgttctctgaagctactaataattacatttaagtcgaatttcgaatctaccactaattagtttctctttctttgtctatcttataaagtcactaaaatcatcctcatgtgaaatgcacgtgttatagcttgtctcatattatcatcttgatcaattaaaaattaaaattttcactactcaaaatactctgataagtaatcaaaggctatatactttaggaaaaaactaaaaataatccactcgtttatttgagattgaaatggacttataaatcttgttggcagtcttaaagctaaagcaaagtctacaaatgcattaacccagaaggaagaggacaagtttgtgccatataattttataattgggaatttaaattgtaaaagaaaaagtacccaataaatggcagatctcctttgttttaacctcatccaaaattaatcccactttttgatcacatccctgacaaaggaatctttctttctaatgctgcaatattagcctggggttcaggaacatccctgcgaggacagagaggaattacccaggaaaccactgcagaaattccaagtatcttttaggtgctttacagttgacacctgaagacctttctgacatggtcactattgtgacaggaataatactgcttcatggtcagtctgtggtgagattatgcgtggaaaaccttggatttccaaagaattaagaaattaaaaacaacagcaacatcaacaaaaataaaaaccagatatgaaaaaaaacctccctaatgaagacgggattctttcttctttgcataccatcaaaaagatcattctggtgtagataacagaagtggagttgaatcataattttttttttagttgattatagatgccactagaaaaggtttaagcgtgtttggacagggaaatagaagtattcttttacatttgctgaaagaagatctattatctctaataatttctgaatgaaatacaatttaattgtagtttcctgtaaataaatacatttccacatttcatacggcagagaagaaatttggttttgtttgcatctcatttttgtatttttaagagtgaagtgtgaaattgtaatgacaaatttccctttgttttcctctatttgagagttcattgctgaatacttttaacgtttaatcataagggggaaaatgaccccagaattatatgatctttaatgactccattttaacaactagatacaaaaagagaagcaaagtgaaggacatcctcttaacccattcagatggaaatgtgaatcaagtggaaacattttataaatgtttattaatataagcaagttgctttatttactagcattattatactgtgcaataaaatactccttgtggttagaagcagttacaaacagctaactattgttttcctatttccattttttatgttctgatatcaggcaacatctacatcaaaaaattacagggggaggaaaagaagagaaattaggataggctataaagattgtacaaatcctaaatggtatgattacagggcatgatggccactgaatagatccattagtcgtaattgaatctgtcaggagccaggtaaatggctgtctctgaggaggtcaccttccacatatgaactggcctacagcttgtattagccttgtcaggagattgaatcctgacttatctgtagaaacctttaaaacaaataataggaatgaagtagcaaagctcaaaagtaacaacattctggacggaaacaaaatgcatagcataaggagtggtgatcacaccagacaaactttattgcccatcctgttcccaggctgtgtggcacgctccccgttttctcctctaggttcacggttagcctccccacccatctctgggctgacattttcaaaggactgcatcaaaggtgattccttgccctgtgacttccataggaagtcctgtttggagaccggaggatggaagagaaagaatatttatttccctgctcttggatatttaattccctggtttcttccttcttgggggccttgtgcttcaccaaggaccatagctggtctttggagtaaggcaagtgaggtcctagggtgaaaaaaatttaagggggtgctcattctcagggttgtgcaaggggaggatcggcactggagagaggccctccttagatttattttgtcactaattccttacactagcccttcctttaattgagctagtttgaagggattctgttccttattttcaaagcagcacaaaccaaaatagcaaaaaaccagaagcctgagaagcacttggtgaaaacttggttattctaaaataattcaggattcttgggcccagaaacttatcctcgtcaagattggatatgtgttgcttcataaattgtaaggccagtgaaaaaagaaaacatggcacagtgctgtggctcatgcttgtaatcccagcagtttgggaggccgaggcgggcagatcacttgagatcaggagttcaagaccagcctggccaacatggggaaacctgtctctattgaaaatacacaaattagctgggcatggtggtaagcaccctgtaatcccagctactcaggaggctgaggcatgagaatcgcttgaacccaggaggcagaggttgcagtgatccaagattgtgccactgcactccagcctgggtgacagagcaagacttcatctcaaaaaaaaagaaaaagaaaaagataatacagggcgcccatgtaagcattactgaaaatgtcaagaaagcaacagcagagcattgaagcaagcacaggaactttcttagtgtgggttcctacatgactacataggtcatatactcatgaagcccagattctgagatatttgcaaatgaaatggttaatcattgaggaattgtgagaactgaaaaagtattagaaaataaaattaaaagtcatttaaaattttgcaagccctatgatggcagcatgggtttattatgcatctttttaacccatggtgtttattagagcactttctacatagtaagaacttagcattaacaacaataatatctatagttactgaactcttattaggggcccaaggcctggtgcacagtaagtatttatttgttgaagtaatgaatgggtagattaaatttagatactggttaagggctttatatgaataatctcatttaatcctaaaaatcaatcctaatgatcaataaatcctcatttaagcctagtgaggtaaatatcattagtatctcttgaattagtctgttctcacactgttataaagataccacctgaaactgggtaattataaacaaaagaagtttgattgatacagttctgcatggctggggaggcctcaggaaatttacaatcatagtagaaggtgaaggggaagcaaggcacatcttacatagcagcaggagagagaatagagaaagggagggagtgtcacacttttaaatcaccagatcttgtgagaatgcattcattatcgcgagaacagcatgggggaaaccaccaccctcataatccaatcacttcccaccaagtccctcccttgacagacacgtgaggatgaccatttgagatgagctttggggtggggtggccaggggacacagcgccaaaccatatcatctgtattttataataaggaaccggaagcttagagagttaatttgcccaaggtcacagagttggttaacgtctgaaatttgtatccctatttctatgattccaaagtctaagatcttaaccactctgcccacaataggcactctgaagaactgaatgatttttggattgtctttgggcattaactgagttgtacctctaacaactctattaacttgatattaaaaaatagcaatccttattatgtaaaaattttaaatcccagctagtaaatactaactgtataagagactctgattgtctacagaacattctctccttagaaagacatatttttagtcttatattttattacatttctgatcttctgtaataagacaatgaaattattatatcatggatataatataatataaatgacggattgtgtcatggatacatacaaccttataaatatgtcaggccaattagaactcttagtcttatattgaaatgtgcaccgtagataaaattacatagatacaaacatctatatattgaactctcggtggcaaatttcaagaactggaagccttaaaataaagaggaaaaagctcttgagactggaatatgccttagtattagtgaaaacaaatttcacttctccaattattgtgtggacaatcctgttatctcataccagtcttctaaaatccttaagcttgaagaatggcttcagcccagaacaagctttctctaagtggaatgcaggaggatttgagcagccagattcaaatgtgcactacaggagagcagaatatctgtgtgtatatggtgactgttcagtttccacctattggccgtccttgcaagggaggcatcattctctcacaagatagattagtatggtaacatgtaataaaagaggagagattaaaaagaagaaagaatgcagagagaaaagagaaaatgagttactgtttaacagatgctggggcaaatgattatgctcctggcaggcaaaaaaagggcaaaaagtttcctgtattgctccctaatacagtcacctttgaagatgtgatgtgccgactctctcaaaactaatctgacatacacagacacctaaatcatagctgtcactatggagtgctgccgctggcttgtacaggctcctgagagctaattgtgtacacctctttcaaattccatattcagggacatcaggttcatagtttgaatttggccgtaataggaatatttacaccacagaaatcagcaaccgttgtagtttttttttttttttcctccctggagagcctgtttaccagcacaccactgactgtagcttataaagacaacataactccatagtgtgtacatgggatagggaaccatactctacttttgtgtgaaggcaacaaataaggaaaaatgaatcagtaaaactcctgcaaactttatagaagactgttccaaaggtcctgctggcatattgcagtttttaaaattcaactacaagtgcattgcaatgtcattcagaaggttgaattataattggcatactctgtagaagaagtgagaagtatggtataatttttataaagttttccattgaaaattaatttttcaaagctatgggagctggtttgactattgagcatctttattgataaatatcaagccctatggcctttctgcaacacatatttaagttaaacaaatgaaatcaataagttataacttaaaaataaattattattattattattatttttgagatggagtctcactctgtcgcccaggctggagtgcagtggcgcaatctaggctcactgcaagctctgcctcccgggctcacgccattctcctgcctcagactccagagtagctgggacaacaggtgcccgccaccacgcccagctaatttttgtatttttagtagagacagggtctcgccacattggccgggctggtcttgaaatcctgaccttgggtgatccacccaccttggcctctcaaagtgttaggattacaggcgtgagccactgcgcccggccaaaaataaattatttttaaaaataaccaaagaaccacaggaaaaacttatgttacttaaaatattattgtttagctggttaaacaatctaggtcaccaacaggactcaccaaacttcagttccatggatttaaatctatttacaagttgcttttatttaaataaactaatagtttctaatacataacttattgaagtaaactgataattaggcatcaatttgtattcattttggaagccaatggacatttttagcagtaccagcagtaaagatactcagattttattcccattgcttggagtatgcagtggcaatgaatgtctgaaaaccactccagaatggtagggggataaattgtattttggggaagattttggccagtatagacagaaatggaagaggaggcctagttactcttgtttgtttttacccttggttttttctattttttgactattacaaataatgctgctatgaacattttaatacaagcttttatgtgggtttatgttttaatttctctaggatatatacataggattggaattgctaggtcatacggaactctatgcttaacactttgaggaactgttgaactgtttttccataacagtgcaccatttttacatttccatcgacaatgtgtaagggttctaatttctctgcatcggcatcatttattgtcttttttattataactatcctggtagtggtatctaactgtggctttgatttgcattctcctgggggttatgatattgagcatcttttcatttatttactagctacttgtatatctactttgaagaaatatctatacatttttatttaattatacttaattaattattattatttttttgagacagggtctcactctgtcacctaggctggagtgcagtggcgtgatggcgtgatctcggctcattgcaacctctgcctcccaggctcaagcagtcctcccacctcagcctcccaggtagctgggactacacgtgcgtgccacacgtggtgtctcaccatgttgccgaggctggtcttgaacccctgagctcaagcgatctgcccacctgggcctctccaagtgcttggattacaggcgtgagccaccatgcccgactcctaattaataaaattctttaattagattgttttttaattatcaagttgtaaaagtttttctacattcctctttactcttaattagttgaaaatttgtcaattgttctttaaggtaaaaaggctaaatcaagaccttatgctaccagtttggataagaagcgaggcactgggtctatctgtagtggtatgttgcagtcagtttgtcacaagagccaattgttaaatttcaggaactttgcaaactacttgttaaacacagtccttattaaaaagcaaattatatcaacttacaattaaatatcttatattagtattagaaataaatatattagatgttctaagcttattacttctgaattatttttctacattttattattatttatgctattgaggttatttatgctattgtctctatggtggaaatattatacaattatgtgtaagtgtacacctcttcccaactccatatggaaattgaccatgtgggagtactgtatttataccatggaagttggcaaacactacacatcagcttctcccctatctctttccaccaagagctgctaattaaacatctgtcagcgcaccactggacaattaggcctggatattataaagatgttccaaaggcctaattcttgacagagaatgtaagcagaagagaattttttaagacccctagcaacccttgctgagagcacatctttgaagtccaggctgtggtgccactttggaacaactctcatgaagttgcatcaaaagatactggtcagctttgcctgctaagttggagaaagtaggccatgtgttctttgaatgtctggaggacgatgatgattttatttgactttgctctgtataatcagtgtttagcatggcgttgagctgatactatttactcagtaatatttgttgaataaatgatagctgtgcttttcttctgccccatggttataaggactgaaatttaagaagcctgattgaatagattccttcaaaatttccccccaatacctacttaataagttcctgggataagaggttgtctcagaatccagggtgagatggggtagagttggggcagaactatacctatggaagcagcaagagaacaaattacttctgtggtacatattctgcaaaaatgcaagagccacagtcaagggcaattgacttcttccttgtaagaccctctttttctggttaaaaaagtttttcttctataaatctagttctctaagtctcataggccagccctgaaccacatggccatgacttgctgtaaggaagtctgggaaagtatctggcaaaggggaagaagagagccatggttggcttaggttaggggtaggcaaactatagtctgtgggtcaaaactggatgatcacctaattttagaatgttttcaagctaagaatagtttttacataaaaatatataccagagcatagccatcatgtcaaaacaagaaaagaagagaaaagtgaactttttgtgtcatgcttttaaggcacagtggattgtggattattttgttatcaaattggatgacaaagtatgtgtttattgtgcagtgatactatacctgtactaaaagataatatacatcaatattcccagattcatcacaatattcccaactcacagggagacaatggtcagaaaatgtgaaaatttacaatggaaaacgtcatcacagcagaatttcttcacaaaaataacaaaagagttgaaaccaaagtaattttctgagtggcttctttgttggccaagcaaagaaagctgtttactgatgatgagttaattaaatcatgtttgatcacagcagctgaaaaaattttttcccaagaaaataaacttgtttcagacgattaacctttcagtgagatctgttgtttgaagagttgaagacactgggagcaacatcaatagtcatgtacaaaacaaggtagatgattttgagtggttttccttggctcttgatgagttgacaggtattaccaatagtgctcagttgcttattcaaggagtcaacgctgagtttaaagtcactgaagaattagcctctatgaatcgtctgcgtagaacaactatgggcaaatatattttcaaagatgttgggaaaacattaataaaacctgaagtagaatctgttaagatgccttataacttatggtgataaaaatgtgtatggagaagaaaaagcttagttggacaaattaataaagcttgtgaaaatgtgagagacttaaagcccattgttacttactatgctgttcatcagcaggtaatttgcagaaagtgtttgaatctattgtgtgtttctgacccagaagttccaatggtgaacttcatttactctggtggacttaatgatcaattctgcaaacttttgtcaaaaatagaagctgaatatcccgatttgccctatcacacagcagttttatggcttagcagcggtaaagttttgttgcaatttttaaaactcaggcctgagacttctggaatgagaagaacctccctcaattactgttattgaacatgagtggctttgaaaattagcttgtgtggcagacttcatcatgtttctcaatataaaattacaaggcaaacagagcatatgtccaaaactcacattatggtaaagtcattttaacaaaaactaatgctgtttcaatcacaagtaatgtcaacctgcttaatatagttcctgtgctgtcaaagttttaaaaagaagcaagagctccattcccacaaacatttgcaggagatatattttccaaaatcaaactaaagttccaatagcatttttggatttcaatgcaagtggaaaggaaattttcaaacatcaaaatccatttattaaagaagacacagataaatggaaagacatcctctgttcatggattggaagaataccattacaatgttcataccacacaacatgatctacagattcaatacaatccctaaaaaattttgataatactatttaagaaatagaaaaaaacaacataaaatttataacaaaccacaaaaggccctgaatagccaaagcaatcttgaacaagaagaacaaagctggaggtatcatacttcttgatttcaaagtacatgacaatgctacactaatcaaaacagtatggtactggcataaaaatatacagataggccaatggaacagagcagagagcccacgaataaatctatgtatctatggtcaactgatcttaaacaataacacacaaggatcgactctttattagatggtgttgggaaaactggatattcacatgtaggagaatgaaattggacccttacctcaccccatgtgataaagtcaactaaaacagattaaatattcaaacataagatctaaaactgtaaaattactagaagcaaagataggaagaaagcttcttgaccttgttctgagcaatgattttttgaatatgaccccaaaagcacaggcaacgaaagcaaaaatagacaggtgggattgcatcaaaccaaaaagcttttgcacagcaaaggaaacaacagaattaagagacaacttacagaatgagagaaatatttgccaactatttatgtgataaagggttaatatagaaaatacaaagaattcagcttaatagcaaaaaaaccaaataaccttattaaaaaatggactaaggacctgatagacatttctccaaagaagacatacaaatggccaatagatataggaaaaaatgctcaacatcagtaatcatcatacaaatttaaaactacaataagatataacctcaaacctgttagaaaaggtaacaagtgttaaggatgtggagaaaagggaacacttacatgctgttggtggaaatgtaaattggcagagccatgatagaaaaccgtgtggaggtttctcaaaatactaaaaaatagaactatatctgatactgcaatcccacttttgagtatacctccaaaggaaatgaacctggcatcccaaagagatatctgcacttttgttcactgcagcattattcacagtagtcaagatatggaaacaacctgtttgtcaaaagatgattggataaagaaaatgtatgtatgtgtgtgtgtatatgaagatatattgaagtttttatatatcctttgctttattgaatcctctcagcacctccaataattaaaaacatatcaggaagaacaaaaagagacttgaggcaaatttactctctggtccatttcagaaagaaattgctggcttagatcaaacatattctatcccttggtgctgggaacattactgagtcacataaaaatttggattatttttagcatggggattacattgaaataatgtatgtcaatattagtaaggatctgatattgtcttgttattaagaaaagtggttgtagttattagagatacatggctacatcattcttattgcccaagctgaccttgagcaaactaccaagcatgtgaatgaggccatcctagaccagccaagctttaagctgactgcagacatgtaaagagatccaggagggaccagcaaaaccagcctaaatatgaattgcctaggaaaccacaggatcctgagaatgaataattgtttgtgattgtaagccactaagttctggggtggtgtgttacacagcaatctctattataggtgaccaaggtaagtgtgtcagatattctctttttgccccttcacagtgctgcaggaggccgacctataactgcagcacaggcttcccttgcttcaggagatcaagagagaggagaatgagggaagtgaagatagtaattccctgaaccccctccctgtagcatcactgtggactggctgtgttacgtgaccaaatgccccaaacacagcttctttgtgttttgtaactacactctctcctttctgctttcagcttaggcgtgatttgggggccccaatgttactgcgtctcccttgtgatctttttaatccctgcccatacctctgtttatagtcttttattaaactcttcaatgtttcctagtttgattgtaccatctgtttcttgctgggaccctgactgatagagtaggccttatccagaaggtaacatctcagcaaagacttgaatgatctgatggaatgagtcacaaagatatctggggagaaatgccaagatcttgcagcagccaggaggccgggtgagtgagctgggcaggagtgtagaagacaaggtcaaaggggcaacagacagtctgtgtatgtgtgtgtgtgtgtgtgtgtgtgtgtgtgtgtgtgtgtgtgtgtgtgtgttggggatggaggtgtgtggtgcaggggagggagatcatgtatggccctgttggcttttgtaagaactttcgcttttacttagaaagaaatggggagccattggagactcgtatatctaattaaatctaatagattgctttctgtgatgtgctgacactggagctctgtgatttagtactgaatttctcctcccagtcttcgtgcctgatgatgaatgggtgggcgtgttgagccagcccagcatgcttgggcctgagttcaaggctttgtgtctctctcctgatgctgtgggtgacatgaccttccttacagtacaggattcagactacagtgtcttttttttgttagcatattcttttcagctctgttaatgacttgggagtgggcacatttttcttactctctttttttttgttgttgttaaagtcagtaggcccttctacactgacttcaaaatgtgtgcttatctaaagggtcttatacaatagagaactgcttaactacttcagtggaaataatacaaggagttgaacagaaatactatctgcctgcctacctcttaaagacggtagtttgtcttaaatatttaaaaggcagagttttgcatgtacaatgtctagaaaatacagatttgaaaggtgttttaatccttcaagtgaaatttgcgtctgagctgggccttctggaattaagtctagcgcaccctccacaggttacatgaataaaggtgattctcttgtaacccctatgaaggaccaccctctctctgctgtttctcagaaatattcctcaggctgaaagtcagtgaaccagctgtagagagctacaaacatctgcatcagatgtaggttcgcccaactaagttaaactgatctttcctaagttatagctcaatcaaaatttaactataaattgtagctacattccttcaggctccattctttgctttcagctcagaaggaaagtaagctatttagttaacgtgattaattaggcaggcagaatctttttcctcctggctaagaatataggtggactattagaacctgttctaatgttttttgtccggccttcaccttaatttcttttacaatttgttgttattgtccgggtgcgatggctcatgcctgtaatcccagcactttgggaggctgaggtgagcccaccacgaggtcaagagatagagaccatcctggcccacatggtgtaaccccgtctctaccaaaaatacaaaaattagctgggcatggtggcgcacgcctgtagtcccagctacttgggaggctgaggcaggagaattgcttgaacccaggaggtggaggttgcaagctgagattgcgtcattgcactccagcctggcaacagagcaagactctgtctcaaaaaaaaatttaaattttaaaaatttatatcccagtgcataaagcaagctattcaataggtatgcagtagaaagaggataggactaggagtcagggaaccagggttttagtccttctaaaacatattagcagctagccatggtggcttacacctataatcccagcattttgggaggccgaggcgggaggataacttgaggccaggagttcaagaccagcctggacagcatagtgagacttcatttctatatatacatttatttattagaatgtagtagtagaatatatgtgtatgttagccgaacactgtggtgtgtgcctgcagacccagctacttggaaagctgaggtgggaggattgcttgagctcaggaggtgaggctgcagtgagctatgatcgtgtcactgtaccccagcttgtgtgacaaagtaagatcctgcctcaaaccaaaacaaagccaaaaacaaaaaacagccctgcccaaccacagccccccacaaaaagcaattagtcatatgacattgaagaattgaagatgaacctgtatccttttagaattttagttcccttctgtgtaattggcttgattagattaaatcagtgaagcgtaaaaaaattttgagttccaacataagactttaagcttactaaaataaaattcccaacaagtataacctattatcatttcatatgagaaaacttctattttctttttttaatagagatggggcgggggccctcactgttgccctggatggtcttgaactcctggcctcaagttatcctcccacttggcctcccaaagtgctgggattataggtgtgagccatcatgcccggcctgagagggtacttttaacattaaaacaaaacaaaagaacaaagcataatctcaggaaaaggacagtcctttaaattgaataaatttatttttatgaaaacttaatacattgtccatattttttaacttcagaatttgtcagagaaaactttgtcatgaactggcaacttctgagatcctttctagttctaaaagcctatctctctagtcttgtcaaaataaatctggtggctgctgacttggtctccagaatgagctggctccataaggctctagaatacgtctttcatcttggtatctcctgtgcctaccacagtgcctggtatagcattagattaaataaattaaaaggtgaaatgatccctgctgaattgcagttcctgtatggaaggagtataccccagaaggagggggtgagcccatggacttccagcttaaccctagatctgcagtaaaagcagtcaaatcggttctaggctccaagtttaatggtcaagtttctcaatcctgcccaaaatctgaatctaggataggtgtctgctgtggcctacatgtttgtgtcccccaaagttaatgtgttgaagcctaaactccaatgcaacaggattaagaggtggggccattgggaggtgattaggttatgaggactcctgtcgtgcccttataaaagacgcttcaggtaatctatttccccttctatcctgtgatgatacacagaaggcaccatccatgaggaatggaacctcaccatattccaaatctgctggcaccttgcttggacttcccggcttgcagaactgtgaacaataaatttttattgtttataaattacccagtctaagatactttgttatagcagcctgaacataataagacggtgtcaaaagtagactcaatatcattctttaaatgggcatttccctgtgtgttcctaaaaccaggctttctacaacagaggcagtacgtttactcattgagcaccagggtgcttggattcaagttttggcctggccattaggtaggtgcatgaccttggtcaagatgcttcacttgctgtacttcaggttccttatttataaaatgtgggtaataactgtaactgcctcataaagttgttctgtggattaaataaatttatatacttagaacagcgctgtttacagagttatgtgtttaattataattttgactaatgagcctcaagaaatataggaatagaagaaaaaatattaaaatagtcctaaaagaaatactggtgcatttggaagactgaaagagagtatcatcaaagtccataaaaagggaattataagccttataaaactcctttgaagcaaaggataacagaggttgaataactttaagtaggttcaatattgattgattgaatgattgattgtgacagtctcactccatcagaggctggagtgcagtggcgccacctcggctcactgcaacctccgcctcccgggttcaagcgattctcctgcctcagcctcctgagtagagtagccgtgactgcaggcgcgcaaccccacgccgggctaatttttgtatgttttttttagtagagatggggtttcaccacgttgcctaggctggtcttgaactccgccctcctcggcctcccaaagtgctgggattacaggtgtgagcccccccacctggccccaagattaatttagataaattcttagagggtgaatgcatagttggttattgggaaaactgttaacggtctgtgatacataattacttttctgaggtgatggggaaccaaattcttcctacaaatgagaaacagaacttcttgtctacacattaaaatgactttggaaacttagaaaaatatcaatgtcaagatctggcagcagacctttttcaaccaagtgatgaggcccaggcacttgtttttttatttttattttttcctaagggtgccccagggtttagaaacaactaagtcagatatttttagagtaatttgtcttaactctttcatcttgcgtaaaatttccattctgtcatccacaaccggaattccactccgtcataccagtctctcctcgtttttttctgctggctcttttcagcgtgtttcatcgtggctgctgtctgtctgttacagccttctcacgtgggagcccctgccccgccccacgagaaaatacatgtttatcattcagtaagtattgcgcaaaatcgtaacagaataattactcgcgccaattccccccagattagatcagcagaaacacttgggctagaactacctcaggactatctaacaagtggatataccacagtggcgtggagagctgcagtgttatgtgttggccaaatgaagtaaagacaccaagtagctattaggcgaagaacgaagcgtcttcgcggcaagtcggctgtctgctttaaattttctgaatccttaatgttatcagtattatttatttcccccgagaaacaaaatctccaaataccaagaagctgttctgtattgccaaaagctgcataggggcaggctgccaacaggactacccgggcacgctgcagtggcatctctaggcagtttcctttaatctgattttccttgggctaactcctcactgcggtgctgctccacagccagcccccgcgcgcagccctccccgcaccagctcggctgcagagcgcgggtccgccgcccacgccgcctttcaaccgcagtgcgcggcccgggccttagacgcgcgtgcgcgcgagccggggagggcgggccccagccggaggaggcggaacagggcctcgcgatatgcagcccattggctctctcctgcagtccccgcccccgggcgttcgaggcggcggggcgggccacgtcaggcagccggcgctgggctgagcttgtggcagaagggaggtaagccgtgcggggcggcgggctgccaccgctgcacccctgctcgggagccgccgggtcgcgccgcctgcggcccggtcggcttgcatggagggcggctgaggccctgcggggctggggctgagctgggagacggggcagtggagcatgtggcggcagggccgcgtcgcggcgaggggcagccgggagggggctttttgccctcgtccggtcctgctggggctctcagcttctggaggactaggccttctgaggttacggagctccgagatacctgggcagggctggctgtggtgactgcggtgggacttagtgggatctcgactcggaagccggtcggcgcgatccttgcatacttagctgcagcaggttgcagtcgtcccactctccttcgaccggttccctagttgggggcagagcaggagattctggccgcgtcctgcctggcctggggtgactgtctccttctcattcccggtgactcactcagatcatgtccacttataatgcaaaggcttatgggtgagcagggcctgttttcagtctcctagttctctggctccgtccgcacttgcggcaattacttgaagaaagagtatgttagatgtatgttttgaaattttcgcagcagctaacgcgtggagacgtgcagttatgttgcatttacccttcatgagttttagtttcagctgtggcgtcctgatatctcagtgtggttcctgaatttggagcttttgaaatgaatgaaatcctgccaatttcatgcagtcattcattcatacattccaaacttttttgatggatgccttaatggtcagcctcataccaggtattaaaatcggcatttcctgcgttttattccagtttatatgttagttttattgtctagatttgagttggaaattttttttttttttgttattttcaggttctagtatccctgaaaccatcgtggctctgagggtgtaatcctgataactgtatcagtaatgactccaggtttcagtggcctatctgtaagaagaggaatgggattagtataattttgagattttccaggagaggagggtagatggcatgtttcctgaactgtgttaacaggaagtaactattttaaaaacacaggatgcattttatgattatgttttactgtgtcaacgaacattgtatctgtccacattcactttttgactaccaagcaagtgcatgtttacaattttgattcacatccaattcctgcgtagaaagcactgtgactcatctgaattttgaaatgaagtaatcatgagctttttaatgttacatacaaaggtatgatattgaaacaattgcataaaaatgcaattttcaaagcattttcacttgcttttatagattagtggaagctaaaacctctgccttgattatttgcttacttaatcaatgttaggtagttaccatctcttggctaatgtttatcaatattatatctattttaacatttgtttcattaaccccaaatttactggattttaactgattgttgtctccagttgacgcctgataaccaaaaggttatcaggaggagctggaggaggcggaacacagcctcgcgccctgtaataaatagtttgaaatcaaaattttcatggacgtataaccagagtttttcatttgttgattgattgatggtgcttaccggtaaatcgtttggcctttttccccgtttaaaatgatttatgaaacagtctgagacataatattcttagcttcatgatacttttgggatattgtccacaagtgattagttgaattaaattgttaatatcactattaggagtttggaaaatttaagaaaatataacttcttaaaattttgcatttgctatttttttgtttgtttggagacagggtcactctgtcgcccaggctggagtgcagtgctgcgatctcggctcactgcaacctccgcctcccaggttcaagtgattcttctgcctcagcctcctaagtagctgggattacaggcgcatgccaccacacccagctaatttttgtatttttagtagagacggagtttcaccatgttggccaggctggtctcgaaatcctgacctcaagtgatccctccgcgttggtgttacatctttcagttctagaaatggacctgatcaagattgcaaggttaatggggaaaattcaagagctgaggacattaaccttctagcgggaaaaaaccacaatgagaaataataactatatttggaggaagtgtaaggaaataatagtttaaggattattagtctataacaaatcttgatcttaatcagtatttcttgatgtataacaaagaacttggtttaagcacaaaaagaaaattagggtgataatttaaattttgatcaagtgggtagtaagtatttctttaggagatgagaaatctatagatctagagatgcatggtataataaagtatggtatacttatatgagtataagtctgtgattcacaattagtaatagattgatggaggttttgttactatttccacatgataagaaacaagatttgctaagctgataggacaagggatatttgtgaatttcctccatgtaaatgatttgaaacaacaaagttttaagtgatgtggaagagcccatctattttcaaacaatggattgaaatgtagtttttgtaaccctctaagtacttctggcctcatagttttttttttttttccccctactcaggtcatattgaaagtaataaaattgtgtttatgattttaaaagtttatattggctttcatttaattagtctgagttactttagttttatatattttgaagatgttccaaaacccttgactttaaatactgtatagctttccattgttcatgaaagaaaacatttctttaggccaaaggaaattgagaatccaacttgcatagatagtcagtttattactattatttaaagatttatctttttacttgcccggggaccaatgaagcatccactgaagctcctaaactggagaaggtatcttctaatctccttttggtcagatgagttcttgctaatttggctgatacatatgttgaacaaatgtaatacagtaattgtgggtgttgtaactgtagttttatgaagtttttttggttgccagggtgtatctttcccttctctcttgacaaacctttctatttggcctacctgctttcataatttattcttaagttctactctatttcccaatcattgcacatgttggtttatgtaaccaaacctgattttagtatatgctattaggacatacacgtggagaagaatggaggaaactttttattaaatgtttttaattgttgaaacacttaagtaaatgtgatttttaaagactcatagttattaaaggtattgtattcattattttttatttattccttcattcagcaaagacagcaactactttggtgctaggtccttaacttatctttaaggaacttacagtattgcatggacttcataaacaacaccaaaatacaatgggataaacattataattagtcgttcacatagtatagtgggggatagagaaaactgtgtgcaaggtttgaggagattcagagaaggctttatggaggaattttcatctgaattgaagtttgaaagtgagtaggaattagttggtgaggttagaggataaggcattctgggcacaagaaagcagtgaggacaaatagataggttagaaacgggacatagacccttaatgtgttaagatagagaatagatcaactttaaaaagtaaacaagggtaaataatgaaagttctcttccacaccgtgttagccattttgagctttaatctggaggctatgttgatccatgagtaatagattttaagtggaagaaagttaacatcagtttcatgaggcaatgtgaggaatgaattgtagtggggtaaggcagacatttgcattacatgtgacagaactccgaaaatgcagtgctgctggagagaagaggatgaattccagatatattaaggtgattgagttagtggccagatggatgtaggggatgaaggagtgatggagtcaaggatacctcctaggtttatgacttgccgagataggaatcacatgagcaatatcagatgtatggggagaataagatcagtagtcttggacatgggtttaggtcacacaattggtgctgttcagtgggtatttggctgctttggcctggagttaaagagaggattctaggctggagatagagattaggatgctatcaatttataggtagttaaaacaatgtgagaatggatgatgcctaagagagtttgtagaataagaaagaataaagcagaagggaaacgctgggaaacactaccctgtaggaaagatgacccagtgaaaaagacagaaggaacagcctaatgacagtggatgtctagaagataaggagggagagaatccaacaagaagagactggtcagatgccatagggaataggagaaagagctaactacagtttttggaaggtttcccagataggcctggatcattaatttgtaataatactagttcatatgattctgtgacttttggcagcaaaattcagtagaaccagagatgataaatagttggattgatacagtatttggattttgttacgtgcgtatggtaagattgcaaaggagttgaaactattggtgaaagaatggtcagagtgatggaatgtgaagtttagactggatagggatgacgatagagccaggaggagctgaaagattgagataacataattggttcaaaggattaaaagtctggatgaagtaaatatacaagtgtttgtagctaaaagggagataatgaaaaggatagaaatcctctggtcagagtagaatattggaatttaagatttttagggtgcagatggcgtgtagggtttggctgtggatatagatggtagaaacggaggtgttcaggaacaatgagactggtggtgcattcgatgaattgctcacccagatgactgtagatgactgtggtacccagggaggaagggtagaatgtgatcctaatttccgaggtttagattgcctatggtggtgatcactatagatgagagatgaagatacttagatgttatgccctcaaaagtacagcgggtgggggtgggatggggtaagtggtctggaaacattcttctgggccttgggacttggaaggatgattagcctttactggtgggggccaccaaagaaggggagtttaatttctattaggcctaggaggtatggggagcatctagtgaagaggctgaggatataagaaagcttattgactatggtgtcagtgtaaaagcttgggaaggagtgagagagcgagtaaagattatttagaggagaagacaggttagaaagagcttagatttgggtataagggtgacagcgcttctctgaagcatatggctagcttttagtagttgggactttaaattttgatgaagctttctgttgttaacgtttacccatcaagtcattatagtttctgtcagagtaggacagttggcatagtactgtttctaaatttaaaaataacatatatgtctccagtgaatatttgtgttatctgtcggagaaaggatggacagtgtggcctatttgctttgatgtaccttttcctggtctttgaattcccaaaatacttttgcaaatacatttcatcatgtgtgccaattcttatctattggtaggattaggaagttatgttgagtatttttaggtcaattctgggcccagaggtataggaaatgccttaatgtgaatggcaattgccatgaatgtgggagattggcatacctgcatttacctaagattgccatctgttattttctgacctagagtctgtttctaaggacagcgcctcacttatgcactaggtcttattccttttaccttccgaaggatttggctccagcatctctctctctgaacattgcatttcccctaattactggattattccgttcattatgcaagtatgctggtatttttccatgttaaaataatagcttttgaccccattcctgcttaagccactgtacaatttatttgttaccccttatggtataactataatcctgtccaatttctttccttctattctttcttaaacccactttaatcaggctttctccctcacctctatcaaaaaattactcttactaaaagtaacttttctgagaagttacttttctaaaagtgactttatttttcatctagagacagagtcttgctctgtcgccctctctgaagtgcagtggtgtgatcatagctcgccacagccttgaactcctgggctcaagtggtacttctgccttgcctcctgagtagctaggactgcagatatgtgccaccatacctggctaatttttctatttcttgtagcggtgggggtcttaccatgttgctcaggctgttttgaacttctggcctcaagcaatcctcctgcctgggcccagagtgctgggattataggcggaggcaccatgcctggccctttcattttcctaaatctaaaggtctgttccaaatttttacctctcagttgacctgtcagcattttttttttttttgagacagctagtcactctctgcttctttatttttatttttgagacagagtctcactctgtcgaccaggctggagtgcagtggcgtgacctcggctcactgcaaccttcatctcttgggttcaagtgatacttctgccttagtctcctgagtagctgggattaccggcatgtgccaccacacccagctaatttttgtatttttagtagagatggggtttcaccacgttggccagactggtcttgaactcctgacctcaagtgatccacctgccttggcctcccaaagtgctgggattacaggtgtgagccatagtgctggcccaatctctgcttcttaaagcactttcttcccttattagcaaaaataccacaattcctggttttcctcctacgtcattgtccctttttagactcctttactggttcttccttatctccctgataagagtgctgttaacattggagtgcttcaggggtcagtcattagaccttatacttctggatcatatcattcagcctttaaatattagcattattattatttattaattaattaattttattttattattattttttgagatggagtctcgctctgtcccccaggctagagtgcagtggcgtcatctcggctcactgcaagccgcacctcccgggttcacgccattctcctgcctcagcctcctgagtagctgggactacaggtgcccgccaccatgcccagataattttttgtatttttagtagagacgggtttcaccatgttagccaggatggtctcgatttcctaacctcgtgatctgcccacttcggcctcccaaagtgctgggattataggcatgagccaccaagcccggccaatttattttttgagatggagtctccctctgtcacccaggctggagtgcactggcacgatctcggctcactgcaacctccgcctcccgggttcaagcgattctcctgcttcagcctcttgagtagccgggactacaggtgcgcactaccacaccaggctaatttttttatttttagtagagacgttggccaggctgatctcgaaaaatgatccacccgccttggcctcccaaagtgctgggattacaggtgtgagccacggcacctggcctaagtattagctttaaatactagtaataccctactagcttccaaatttatattttcagcctcgccttcccttgaactcctgactccgtatatccagtgactactcagcattttctgtttggatgactaatatatatttcaaactaaactctgaaatttccttttttacctataatctttcctatttcagttaacagaaactccatcctttttatgagataggctaaaaacctgagtatcatccttgactcttctttatctcacaatctatatatatatactgttactttggaaagtgtgttggctataccttcacaatgtatttagaatccaagtacttgtcactacccactgctatcaccctagtctaagcccccgttgtttatgtccggatcttgcagtagcctctatattagttatcaattgttacctactcccaacattttgtggcttaaaccaacagttatgtattagtttgtgattctgtggttggcagcttaggttggacttggggtagatgtggggcagctcttttgctggtcttgcccgtgctcactcatgtagtgatcggcactggtaggtttggaggcctcagctgagatggcttatctctgctctacgtggtcagtaaactatctcatgtttatgtttctttacgtagtggtgtaatggaagcaagataacaagaggaaactatgtggccttttgaggccgggacttagaacttctacagcttcactttccctgctgttggtgagagcaggtcaccaggtcaagccagatgaaggggagagaaaattagcctacttttttttctgagggggtgcagcaaagtcactttgtaaagcagtttgtatacagagattgggagcaattggaggccattttttgcaaactgtcctggccttctaatggattgcttctatctttccccttacagtattgtcagaacagcagccagagtgattttataaaaacgtgagttagatctcttctctgccccaaactctccagtggcttcccgttgccacccaaagtaaaaggcagtcttgggattgtcctgtgaggcttgccatgatctgacccatttgttgcctctccaactccatttacagccactctctctctcttacttaatctgctcaaatgagcctctgctgttcttcagacatctgaggcatgctttcaccatggcattggcactgctactctttccgcctagagtcttcttttctgagatgacgaaactgctcttttactccccttcaggctactcgagtacttcctcagcctttccctgaccatccttttaaaaatagaaacctctctctctaatactgtctatcctccactctggtttacttttatccatagcacttatcttcagaaatgctatgtaatttactattttgcttattcttgtcttgcctctactaggaatgtaatctataagggcagggatttttctctgttttcccagtgcttagtatagtgtctgatacaaggtaggcatctcataaatatttcttaaatggaggaatgaaaggtactgcaacctttttcaggattaggtatctcttccattctttatggaaaagctctggaccattatctgaggaaattcctggtctcctttgcaagtacttttgcaatcactatttatttatttatttatttatttagatggaatcttgctctgttgcccaggctgaagtgcagtggcacaatcttggctcactgcaacctctgcctcctgggttcaagtgattctcgtgcctcagcctcccaagtagatgggattacaggtgcgtgcttccacgcctggttaatttctgtatttttagtacagatggcacttcaccatgttggccaggccagtctcgaactcttgacttcaagtgatcttcctgccttggcctctcaaagtgctgggattgcaggtgtgagccaccgtgcccagctgcaatccattttttaaaagaggtcttctagaccaagtattcttccacatccagactctaatttattctttgcaagaagattatcatgttctcttaactatatgcaatacctttcttgatacttaatagcaacctcttcactttgagttgtaaatcataacattttttgtacaaagcaaagctgaaacaggtgaaaggaatagtctagggcagaaaattttcaaaccttttctaaggtcttagactctctccacctccacatatcttactgagaacttcagataagagaagtgttttattattcaaaataaaggttttattattcaaaataaagctattttacatttgaatttatagcatactcttattataaagtcaatctgaaccatgaagctattataaggagtgtaatattgaaatgaatgattatgaataaaaatgatactctctatatgtctcagcctccaatttatttttgtattgtgattttgtattttggttttgttgcagaccatcaaggaaatttccatccacacagattagcagttgaaaatggtaataattttttttaacagttcacattgcaatcttgcaatctctagttacttttttaaaattttcttttatttttaaaaatgtcttactaaaacatacacagattaatagggaatatagtaaatgaacttaatttcaacaacatcaacattttgtcaatcttgtttttctctctaacattttttcttccctagtaattgtctttaattaataaggacttcttaaagtactattactaggccattcattaacaaccctaacaaaattaataccaattcctaaatattatccaatacagtccatatttcagaatttctcagttgggccaagattgtcttagtagaattggttttttgaaatcagaatcatgtaagtttcccaaatataatataatttggttactatgtctgtttagtcacttattctgtacaatccctccactccttttttcccatgtcattgatttgttggagaaaccgagtactttgtcctgtaaagtgtcccagattctggacttgatctattgctctgcaagtggtattgtcctggaagaggtaccttgttcctgtatctcatatatttcttgtaaattggtaattaaatatagagagttgtgtatattagtggcaaatttttttttaggtaagagtatttttacagaagcctgtgtatgtcctattccatcacccatgaggatacaatgtgtggtattcttacttttagtgatgctaagatgaatcaatggattcaagtgggatcatcctgatccctctaatataaagttccctatcttcctttaacttaatatttttagccacagttgatgattcattcacaaatcaaagtatttattaacaaagtaacttcatattggtaaagatttttcttaagcccgtaaacatgctttcattttttctttcctcacgtttctttttacaatacaatcagttttttccctgtcccctcatcctacatttatacacgtacacagtcttcagtacatgttgaacatttgacataaagcttgtaaagagatatgaaatggaatggacaacaaaggaaggcgaggtagggaagtaaggattatccacccatctacctactaacttacctgtctcctctccttctctgtatcttactggtttcagtttataatattttaaaagctatgtgggataagtatggcttagagggctactgaggccttacagggattggaaattggataggacctgggcaggtgttgactgcagcattggtattaggtatgaattgaatataaatccaatctgcagctaagcacacacattttaacatttgttgtgtatagtcaagattggccccaaataaaattgagaagcaaatgaagcttatacagtctgcatgtggcatccttttatcatatagctttttttagctgatatggacaaaagtaaattgagcttccaagaatttaggagactcatgcattgctgcattgttttagaaatggataaatgatttcgacttctgcatcttagtgtatgactgctttgttctttcagttatctgaaccccaaactttggagtcatccttcactcttcccacatttcatgtctaatccattagcaaatcttaccaaatatttctgaaatacttgtaactgcaggcatgtatcctttgaccaaatggagacctaatgtatatataacatggtgactatacttaatgataatgtattgtatagttgaaatttactaagagagtagatttcaagtgttctcaccatacagacacacacacacacaatggtaacaagatgaggtgatatgtttgattgtggaaatcatttcacactgtatacatatatcaaaacatctgattttgtaccctaaatatatacagtttttatttgtcaattgctatggtttgaatgcttgtccctctcaaaattcatgtttaaatttaattgccattggccaggtgctgtggttcatgcctgtaatcccagcactttgggaggccgagacaggtggatggcttgagcccaggagtttgagaccagcctgggcaacatggcaaaacctcctctctactagaaaatacaaaaattagctgggcatggtggcgcaagcctgtacttccagctactttggaggctgaggtgagaagattgcttgtgcccaggagatgtaggttgtagtgaattgagatcatgccactgcactccagcctgggtgacagcaagactctatcttataataataataataataataataattaattgccatcgtaaccgtattaagaggtggaattgttaagaggtgattgtcatgagggtgctaccctcaagggtgagattggtgccaatgtaaaagtcggtcctctcctgccctctgtctctttgcacttccaccatgtgatgatgtggcacaaagaccctccacggatgttgacaccttgatattagacttcctggcttccagaactgtgagccaataggtttctgttctttataaaatattcccaatctcagatattctgtttagcagccaaaaacagactaagacatcaattatacctcaataaatctggaaaaaaataaacatgtcctaagtctgacctcttcccactatctctactgctgttatccttgtccaaagcaatatgatttatctcctggattattgatgtaacctaactggtccgtctctttttctttttttctatccttgccctcttatggtctctattcttcctagaagccacaatgatctttttaaaatgtcagtcatatatgccattcctctttcccaaaccctgtaggacttcccatctcactgagaaacatccaaagactcccagcaccctgtagaggcttacatgatctgggtttctgcttcattctgtaatctctcactgcctaacttgctgacttgcactagccaacactggtgtccttggtctttcctaaacttgccaaacatgcttccatctcaaggttattccttctgtttggactgcacattacttccttcaggtgtctgttcaaatgtcactatcagaaagagctttttttattcttcggcagatgccaaaacgtttaaagacctctctaaaatttacctattgatgactaaaattttgattttcttggtattatgttgtgtttgaatttggaaaattaaaaactacttatactgtagttcaagcaattaaaaatgccctctagactgaagctaacatacttgattaaaatgagactggaggatgttgaacacagtggaggaacacttgatgtttttctcaggtgcagatggattaatctcctggcaaacaatttagaatcaaaggtaattctgttagcttacttgtttggaactctgcaggaccattatagcttctaataactcaaaggtgtgactttcgcattaaatagttcttaataagtggtataattggatcaagtgagactttttttgccttggcgtgtgctgtggtgaaaccacctctttagagaatgataaaaaaccatggtttcaagtgaataaataagatcactttttttaaaattgcaattaaacattttatttttttatttgaggagaattaatttctttgtaatttaaaataagtaatgtatgccccattgtaagaacaaaattaaaagtagcaaaggcggaatacagtaggttacataatcatccatcatcctgttcagaaataaccctatcaacatttttgcctatttgtttttttaattctatatttctctctatattactcacatgcacacattatatatactatatgtgtatacacacacacacgcacacacacacacatatatgtgtatttatttttatttttgagatagagtcttgctctatgacccaggctggagtgtagtgctgcaatctttggctcactgcagtctcgacctcctgggctcaaacagtcctcccacctcagcctcctgagtaactgagaccacagggacacgccactgtgcctggctaattttttattttttgtagagatgaggtctcactatgttgcccaggctggacttgaaatcagcctcccaaagtgttgggattacaggtgtgagccactgcgcccggcttatgttttaaactttgttgtgttcatggttgtatgcaaaaatttctcaagtgttttttattgtaaacttttctttacattattaaaactctttacaaatgttattttcaattactgatcaatattttatctgcatagtccttagtttatcttttagatttgtccattaatacttttgcaaaaagtgtgcttgattttaaacctttttaattcttaactcacttttaaaatgggagctgaatagaacttgaaggatgtatgccacactttgggatatagccaagaagtgtcagatagtaagatcaaatgctcaggaagtggtacccagactgcccaccacagaatgatttagtttttggcttacctcagactttcagcttcatggtgctaaagttccctatgaaattaggtatggtaggtgggacttggggagacttttgtggttctgggaatcatactggttctaccttatttgtgtggcttgttcctgagctgatctgatctttgataacctttctatcagtttggaagtaagccagattgggagcaatttcttagatagtgtttgaatttgggctgaaaggcagaagtagtctttgagggtgaaatgaaactcttttgaagattggctttattgtaagttgctggtctttggagtggctgttgctgttcatctagttggtcatttacttaaaacagagtgttgaaaagttcccttaggcctgtatgtatgaaaatcatatatactagttttaacatttgtgaaattaaaaaaatcatgaagagcacctgggcgcagtagctcatgcctgtaatcccagcactttgggaggcccaggtgggtggatcaggaggttgggagattgagaccatcctggctaacacagtgaaaccctgtctctactaaaaatacagatacactgggcatggtggcgggcgcctgtagtcccagctactcaggaggctgaggcaggagaatggcatgaacccaggaggcggagcttgcagtgagccgagatcgtgccactgctctccaccctgggctacagagcaagactccgtctcaaaaaaaaaaaaaaaaaaaaaaaaaaaaaaaaaaaaatatatatatatatatatatatatatatatatatatatatatgaagagctacatattacatcttaaccccttcttcgttctcctcctcctccatgtttgtttaaataaaattcttaaactaactttatctgaaagacatcctacatactgtactctgtcaattggatgtcagcatttcaccccaagatcctcttctgattcttgaatatgctgcttgatatttccacgctaatatgaaatgatttactaatgaactcctgcccaggatgattgcaaacgttaactaatatctgattatttagtaccctataagtaaaaacagccatgagtaatgctagctgtataatagaagattagtaaatgttccttttttttttaaagaaattatttaaaattccttttaccccaatgggaaatacacagaggtgatactgtgggtttttaaaggattgtaataaatagcagattaagcacatagctatgataaataatagctgtcaatggaagcattcatgtaaaacttatgttgtattaaagtaacaaagacccattttccatctctattagattcagctggaaacagtgaagaaacagtcttgttagcttttacatgtgttctttgatttttttttttaaagaaaatgtaccaaaatttatgacagcataatgaaattttactggtgtagattctgctgattttggatttgaatttggctgaagttcacctttgcactatctacacaaaaatgattcgcctagttaaaaaaaaaaaaaactgggagtttaggatgtgtctaaaaagaattatcatcaattcctaaatgtgttggttactaaattcaagttactgtattaatttggacataaagttgtttaaacatttatttttctacttctggctgttatttattttggtctttgtttcatgagtcttaattaatgaaaaagatatagattcctctctatttcttagtttctgttttggaaagtttatctgaaaacaaaataaacagtggaatcctgattctaacatttttgagactgttaggtactgtgctaaacacaataattcagcaaacatttattaactgcttattccatgccagaccctgaagggggtgaacaagaagctgcttctcttaagaaatccaaatgtccagggtaataatgcagcaggcttggtcagtggggacccttcccacttctgattcttctttactggcatctgagcaggtgcagctgctatatagatggaaactaggcccttcagaatgagacaagaatgtcttgaggagtgattataaccctctcagagctggaagggacattagagactgatcttagctctccactttgtcctctcaaaccatatcctcatattccctctgcctggaatgtgatgccaagttttagttcaagccctgttttctgaggcagctgcaggaactgagaaagaacatgcattggcttccttttgatcttcctgcttctggacatttcttcctgagcgttccaatattatttcaagccctgtttttacaagtgaactcatgcacacacaaatttccctgtctcattgagctgtgttttcacctgtcacatggtgaggtttcctgccagctaagtactcatttgcagtggcattgccatctgtgtgtgtgtagtgtttaagcaatcatttgggtatataattgctttaattaattttagtgattatttacttatttaaaaaaacagaaaatgtagatgtgaaagtgttgatatcagtgacaagaagtatagatttactacagattgacaattgtcgtgatggaagtggccaattgttatcctttgttacctactcattgaacttaaactgaacagtcaatgatgaaataaaggcatataaccaaagaacatatacagatgtgggagatgtattgctggtgatggtgccacaaggatgaaagttaagtttagataaacaatttttatgttttgtgctctgggcaaggagtaatcctttaatatgtaatgtttgcgcattagacttgattacctttttaggattgcagtatatacaaagatacaaagctgtttgcatatgctgataagctgctttgggaatttgatttaacacgtatgtgcaaacccaggtaattcatttaaagatttatttgatttcctgagatgcagcaaaatataatggaaaaaacaaggtattagattcagactcagaataataacatttaaaaaccgtttgctatgttcatggctctgagcaaaatgctttaatggattatcttaatttagctttagttttttaactttattattgttattgttattattattattattattagctatagggcattgttctgttgcccaggctggagtgcagtggcatgataatagctcactgtagccttaatctccagtgctcaaatggtcctcccactgcagcctcctgggtagctaggactaaaggcatgtaccaccatgcccagctaatttttaaaattttttgtagagatggggtatcactatgttgcctaggttgatttcgaacccctggcctctagtgatcctcccgcctcagcctcccaaagtgctgggattacaggcatgagccaccggctgcttgatgatcttagttttacaaaaactttaagtcaactgtatctatactttattaaagagtggttaagcatgtgagatctggaggcagactgtttatattcatgcttttgcttcttacataattaggcaattaattttgacctctcctttcctcacttggtttttcatatgaagataaagttaatagtagtacttatgtcatgaggttgttttgaatatcgagtgagagaatacgtataaaaagctttgacagtacctgcctggcacatggtaaaattctcaataaatcctggctgttaataccactgtataacctcaggcaagtgacttcttccctgagctcctatttcctcctgtgggaaatggagttaatatttacctcaaagttgttgtgaggatctcgtggaattagttaaagtgtcttgtggagtgcttagcacataggagatgtttaatccaatatggtattccaaattctatgttatgctttgcatttattcagttaatctttattgaataggtatttgttatatgctggggagatagtggtaagagctgagatcgtgccactgcattccagcctgggcaactgagcaagactccatctcacaaaaaaaacaaaacaaaacggtccctgccttaaagagtttgcatttggggaggtgggggtggagtagggaagcagaaataagtaaatgacaatcatttgagattgtgataaaagctatgaatggtacaatagtgggtcactgcagtggcaagtaggggactatttgaggctatgggggtggtggggggatagggaaggttcgagggaacatgtgaagggagagaagaaacagcttatttgaacaattgaacaagtcaagagcacttgaggctgaggggcctgagagttctagacccagatgtcgaaggagctgagggtgtggttgtcggggtggtttaaggaagaaactgaaggccaatgtggctgaagtgccctgactgaaggagagttgcaagaccagaaccttttggccttcctatagagttgcagtggggagccattgaaaagttttcagcatatgagttaaaagtcaactgtattttattccatgtctttgctattgtgaatagtgctgcattaactatattttaaatgggaatcttatgtatattctaaccttggggctggtgtcttatttctctctagtgacttgcatacaagatcccatctttgcatataagtaatttatcttttatcattaaaacaatttttctacttcattactgctcacttgatgagagattccttatcacttaaattcaaattcttttccatcattcaccttccttgactgtcccacatggtattgagggagggaggaagcacacatttctacagtgcctgctatgtgcaagactctcttggctttaaggcgtactttatattgttatgcacaagaccttgtttaaccaatgaggaaacaggttccaagatggtaagtgatttgcctagtgctggaatcaggatttgcatccaggtctatggttccctcctccctttagcccccaaagggggctccccaaagcacctcagagctttgctgtctgtgtcaggttgctctgttatcatgatgatagaggtaggtaagactgtgagcttaatcagattaaggtgttattcttctctgtggacaatcttagagtttgcaaaagcatatatgtcattgcttcacagtgcaccattgatcttattcatttgaacattttcactgtggttcttctaacagtactgcgataactttgtttttgtccttgtaaccattaaggactcaaatacagagatactctccatgtccattttcgtgtatgcacattgactttgttgaaaatagagaaatttactatcttgttgtaaaatttttttgttcatttggtcttcagctttcattagcactcagtatgcaaattaaaatagctaaaccatatctattccattctacatgaatttagtaatttagtttttatgaaaaataccaaatgagcttgattggtcactttgcaacaatcaaaaatgttgccaataaacttgtaatcagtctatatagttcttttccagagtaagaattttattttggaggaagatttcctagcagtctacttggggaaattataatagttatttttctccttgaaaatgaaggaagaaagcttttaagtggtttaaacttaatctatctggctgaattacattggccccttttcaatattactcttttcataaagcgttggtaaacataagtaacaaagtaatctttcatcattttatcaacaatttttctactaaattgctgctcactttatgacaccctttagtgatggatttctacgctttcagtgatttgggtgtcagaaagttatatcctctatttctacaaaatgtattataatgttagtcaagattttcctattttggtaactttattaaaattacaaaacacatattctcatagaacaattagaaactgggaatgagcaaaaataaaaattatccacaattggtacattccgggcttttctttgtgcatatatactctggagcgagactacttaggttggaattccagttctgtcacttactctgtgaccttgggaaagttatctaaattttctttgcctcagtgtcttaatctgtaaaatgagtaactatctccgggttactgtgggggttgaatgagttaatacatgtaaaatgcttagaatattgcctttcccctagtaagagccacatacatgggttttaaaagaccttttattatggagaatttcaaacataaaaatagagactagtattatgaattccagtgtacctattattaacatttagacattcctgtttcatctatcagtcttcttttatttttctttcaatacttgggtattttatagaaaatcccaaatattacatccttacactgtgtatactttgtaccatattaatatctgctaagaattaggtaggttattttagagagtgagtattcaaaatttgagtcatttttaaggggagaaaatacaagcaaaatatctaaagtatccattctgtgatgttttactaatttagttaactgaatggtatttgaagtaagattgtgaatgtggagattttgcgatcatttattggccaataacacatttaaaataattaggtatcagttttattttaaatatactgtaaatattttatatgaacatgaagtctttatttagaaaatgttttgtactgggcaatatatgtaattgttttggtgaaggaaaaatacttaaaaattataatattggaaaaaaaaaagtcaactttgaagatttagattggatgctgaaaaaattctagagattcataagcccttagattttaaaaaataactatttttcattgatatactcatatatttagcatatacatatccatatgccacaagttaaaacacagaataattagagaaaatttgtaactagttaggcattattcagttttaagtttttttttttttttttttttttttttttaaacagtggctggttctgtcacccaggctggaatacagtggcacaatcctggctctctggagccttgatctactggactcaagtgatcttcccacctcagcctcccaagtagctgtttctacgggcatgagccaccatacccggctaatttttaaactttttgtagagatggagtctccttatgttgcccaggctggtctcaaactcttgggctcaagtgatcctcttgtcttgacctcccaaagtcttgggattacaggtatgagccaccgtgcctggccaagtttgtagttttattttttattttaatgcctgttttcctggacagcaatcagttctgacttggaatttcctgcctttgatcttattttaggctcccatttcaaaatctgtaagtagcatgtgatattgagaaggaactaaattgtaaaggcaggaatttgatagaattcattgtacttttattaaatggcagccagtgagatcatctgaactcatagtcatgtaaattttctcagtacttgaattattgatcttaaaattcctggatacgatgcagtgatatggaattgtgcaggtcatgcctcatgttaccgatggtccagtggaaagaacacttggttggaagtcaagaaacctctgttctcacttgaactctgtcatgatgactttcctttttggcaagttgctttaacctctctgacattgtttcttcatttctctagtgaaaatatgtagggagggagatgatgttaggtccattatattagttaaggaagtgctagatattgcaacaaggagaccccaaaatgaaatggttcaaacagtgtagaagtttttcctgtaatagttggagttccaggtatgtagccgtgcagcaagctatcatttagggatccacgttcttcccattttgtttcttcaacagagtcccagggccattgtcttcatgtgcgtggttgtgtctaggctgttgcccagaattcactctggttccgaagagagagtggaggaagcagaccccagcctggaaatggcatgtcacttttgctcaaacaccactggagagaacttgatcacatattcttactgtaccatatttgaggctgggaaatgtaatgaagttgttcaggttacagttttgttaatacaaaagaagagaacagatattggtggataaatagcagtctcttccacatcatatggttgctgctttctctgattataatattgaccaagtggctctgtcacaccactgagttgctatctacttcagcttgattttgaaattattggctaagataaaagtattttctactctgggtttaattttaatgtgtcttaatggtctctctgagaatataataactaaaaattactgttttcttacacctgctctttattgttgaaaactttcaatttttatgaatttttatgaatcatatacagttgacccttgaacaatttggggtcttggggtgccaatccctcatgcagtcagaaacctgtatgtaactttttactccccaagaacttaactaccaatagtcttatggatattataaacagttgattcgtacacattttatgtattatatatactgtgttcttacaacaaagaaagctagagaaaagaaattaagaaaatcataaagaagagaacttttcattaagtggaagtggatcgtcataaaggtcttcatcttcaccttcgtgttgagtagggtgaggaggaggaagaaaaggggaggttggtcttgctgtctcaggggtgccagaggtagaagaaaagccacgtataagtggaccttttctcaagggtcaactgtggttaaaagggttccaattatcttgtcctgttattttgggagtgttggtggcagttggattttttaagcctttgaagcaagagctgaggctaagtgtgagcaggtgtcaggatttcatacaaggtgatgaaacaatcgagctgcctgatcttagagagggtacatggaaatacttagggactgggaagcagtagatgagaagctaagcagcagaagaatgagaaagagatccatattagacagtacaacaaggtgggcatttgaaaagtataggcagaattttccccctcttttttgagggacagggtcagtcagttggtgactctagaatccacccttgagccatagtcttgataaatttataaaatcagctcaaaatttattgatagtgcccatcagcttttctataagccatccacaacaagtaagaaaaaagataaaaattgtcaaaatatttgtttaaaagtatggttttaggctgatggttccatagcttaatttgtgggaggaagaaactaagtaaattccataactgataattggaatagttaataaaatgttagaaaaagaaaagtcctggattttgtgtctctaaaacatagagcccattaatgtgaatgaagtacttatttttttatcagccattttatcagtgtgctgatgatactgctcctgtaaactagctttaagaatgtactctgggctggatgtggtggctcacacctgtagtaatcccagtgctttgggaggctgagggtgggaggatcacttgagcccaggagtttgagaccagcccgaggaacagagggagtccccgttgctacaaaaaattttaaaaaaactttagccaggcacggtggtgcatgcctgtagtcccagctacttggaaggctgaggatgggcggatcacttgagccctggagtttgaggctgcagtgacctatgattgtgtcactgtactccagcttgagtgacagagtgagagaccctgtctcttaaggaaaaaaaaaaaaattctgtttagccctgagtttcagccatatgactgcccttgagccgttcctatatagaaatttggtagtcaagagtgctcaaagtcaaatgtctgtcttcgtcatcattggaccctcctcctccaactaccttgtatatcagttattgtctctgctgggttttcataattgttagatttcctcttgcttttaagattgtgtcctttatttgaggtttgacattaagtacttttgtgtgatacatagttgtacaatatcctagagaaactattgagaaagttgaaaacccaaagtgttttatctactgctcttttattagtgcaattgatagattaattttcttggaagtattcttaggggctgaactaccttggcagataatgtgataattgcttatattaaacaactgttttgattcactgggaacttaaagacttcattaaaaattctctttctgatttaggtttagacagacaaaaaaggcatattgaaaggttggagataaatctttgaaaatcaaacatgcatttttgtagcatgtggtttatggattatattgttactggtttccttttagtaaaatggcatgacaagaagtaatatataaattgtttttccttaatgtataaaatacccaaaggaaattgagtttgaaaataacgtagactgctctccagactgggtgacaaagtgaaaccgtctctgtctcttaaaaaaaaaaaaaaaaaaaaaagtaggacacgtactacacttgccaatgctaaagtgaccatgtgtactgttttttgaaattccctaagaggatatgatgttttatacctagaaaaggccaatgtttgtgattaaccttgaaatataagtcttcagcaaatgaaagacacttgcaatttgtagcccagtgatagcaaatcaagaatgatgtaaagtcatattgcagcttgggtagtggttttgagaatgcttaatggccatttgttaggaaaggtaaagttactatagatttaaaaaacatattcattctctgaggtgtcacactgaaattagggctgtcttttgtaatctttggtatttgtcatctgtacttaggtaatttagataaaaacaacactgtttttccacagtggcccacctcctgaaaacaaggtcatctttttggatggctcagcttcttcacttctataataagctattagcctacccagctgctcacctggtccccaaagacatactggaattacagcattctgggcctggatcagagtgcatagccccacatcttcttctgtatagttctatcaccattgatatttgagtaattatattctgtgacatatcaataatcttacctgcttctgtggatactgtaaagtcagccttctgttgagttagattagatcatcagaaaactctgtacttggatcccagtagctgagatttttttttttttttttttttttgctgaataacatgttacattttgcctgtggctttatccagggtttgcttaaaaagtaatattactgggcacggtggctcacacctgtaatcgcagcactttgggaggccgagatgggcagatcacctgaggtcaggattttgagaccagcctcgccaacatggtgaaacccctcctctactaaaaatacaaaaaattagccaggcgtggtggcgggcacctgtaatcccagctactctggaggctgaggcaggagaattgcttgaacccagaggtggaggctgcagtgagctggtatcacgccatttcactctagcctgggcaacaaaagcgtaactctgtctcaaaaaaaaaaaataataatataacatttccttttgcttttgttattgagaatattgcatattatatcactctatattccatttataaagcccaatgtaagaaatttccttcagagtttaaggtcacaaaaatgtttgttttctttgataaaggatattttcttaccttttagattataaaagaggtatcatttattttgtttatttaccctagctgcctgggagcacagggccaaatttgaatgttaattgtaggaattatgtcaagaaattttgtaaattaatttaaaaatagttttatgtactgggagttagcaaactatgggccacccacttctttttgtaaataaagtttgatcagaacacagctatagtcatttatttatgtattgcctattgctttcatgctacaatggcagacttgagtagttgctctctggccctttacagaaaaaagatttctagtcctgatacaaatagttacatgtgcctcagaccaaaatgcagtaacactgaatataaagcaatatgattactgttagatgtagctagttggaagaggcttaacagagatgtgctatgaaaggagtttaatatttaagcagtggaagcatataggagacattttatgtgggagagaagaaatgaaatcctgtaggattgagcagattttgaacatgtgggaccattttggaaactgttttagctagattagaattacagcagtgaaaatgaagttgaatgggtaagactgttgataggaaggcataaaagctaggcatcaggatttgcatttaatccaacaaacaattgaaaacccgctatgaaaatttcacagggaaatgatatgatgggaacagcatttcagtacagctaatctgacagcagtgtactaactcagcatggagagccccaagactaagcagttactggagtaagcctgccatgaggaactaagatgatgagtgtagaatgaagaggaatagtaacctctgaggtgctggaaagaaggaagccgattttgtggctgactggatttagagagtggtggtgaacgaaattgtgagaggataactggggtaaaatgaactgaagtgacagttttttgaaaggaaatatgtgttttgtttttgatgtccctaatttctggtgttttagagcctcctaagagaaagtatggaagcgtttggagatctgtgccagatgacgactgatagctgtgggagagtttgtatggagggacaacagcacaaggcagagtggctggggagtgcctccaggagggaagatagcactcgaggagcagagtggacagaggaacaggaggagtcagtaaaacagtgtttcccagtgtgtatcccaggacagactgatagtatagatggttagcaggtatttccattgttgcatggccagatagatttgataaattctgggttaagcaaagttaaatagacttcttgtattagaccctcttatgttctttaataatatgcaacattatttatatctccactacgatctctccctccaagtttagattcctgtattcgactttctacgagacatttccccttgggatacctgtgaggcatctaaaacttaactgtccaaaatggaattctttgtcttcctcacaaaacttggttccccatgtcaggtgatggcagctctatcttttctttttagtaaaaaaacgccgtggtaagaagtaacatagaaattatattgttccatgtgtaaaatggccaaaggaattgagataaaaaataaagttgctcaagctgggcatggtggctcacgcctgtaatcctagcactttgggaggccgaggcgggcggatcacttgaggtcaggagttcgagactagcctggccaacatggtgaaacctgtctctactaaaaatacaaaaattagctgagcccagtggtggtgggtgcctgtaatcccagctactcgggaggctgaggcaggagaattgcttgaacctgggaggcggaggttagtgagctgagatcgcaccactgcactccagcctgggtgacagagtgagactctgtctcacaaaaaagaaaaaaaaagttgctcagattaaaaaccttggagtcatccttgactcctttctcctatattcttttttttttttttttttttttgacagaatctcactcagtcacccagcctggagtgcagtggcacaacctcggcttattgcaacctccacctcccgggttcaagtgattctcctatcccagcctcctgagtaactgggattataggtgcacaccaccacatctggctaatttttgtatttttagtagagacagggtttcgccatgttggccaggctagtctcgaactcctgacttcaggtgatctgcctgcctcagcctcccaaagtgctgggattacaggtgtgagctaccatgcctggccctttcttctgtgctcttatccaatccattagcagccacattggctttcccttcaaatatatccagaatgtgaccacttggtaccccaagtgattctattgaaatcctactgcctctttgtgcagtagctttccatttcactcaggataagtgtgtcagtccctgtagtggcctacaaggccttttatgacctggcttctcattgatcctttgacctgatttaccattcttttcctccttcactctgctgtatgcacatctctttattcttcctaagacagggcttaagcaatttattagcttagggctttttcctgtgcctgtgacactcttccgcctagatatctgtttggctaatctaacttcctttcctcctttaagtctgttcacatgccaccctctctagaagagactgacctggactaccatatttaaaatggaaagtgtgcacttctcccatttctcatctcctttattctgcttcacttttttttaattagcacttaccatcttctaacatattttatgtattatttgtttaaaaaattatctgctgctttctactagactgtaagctccataaatgcagagattttttgcctattttgttcactgatataactcaagcacctagaactgtgctggacacacaataggcaactaataagtatttgttaaatgagtgaatgaatttcaagataggaatatatgtccgcatagaatctttctttcacccatggagatatttttttcctgtgtttcccagggacacactttaggagactctgttgtgagtattatggaattcaaaggaggagaaaactacaagaaagttgtgattgacacaattgggaagttaaaaatttttgacctgcttaagctaataaagtagatttagataggaaaatagtttgcaatcttagaacaagttgttttagtgttgtggaatgtcaaattcggggaggaaagttggacatagatgtcgaagaaaaataccaggataaattacccattcagggagtttagctttggataaaagggtggaaagtacagattgagtattctttatctgaaatgctcgggaccagaagtgttttggatttggatttaaaaaaaaaatttttttttggactatttgcatatactttaaaccggttgaaaatccaatctgaaaatccaaagtgctccaatgagcatttcctttgagtgtcacgtcagtgctcaaaaagtttcagattttgtaacattttgaattttgtattttcagattagggttgctcaacctgcagttagaaaaggctgctagttcattacaatatgctttgttttttgagatcaagggaacttggtttttctgcttgttataagttaatctagggctgtttattgacataaattttaattttaattatattgtaaaagtaggtgacctagagggccctgtttttcaaaataatgtaattggtaggttcagtgcttcatggaaatgggataaattgggatccttaggaaatcctcttattagttccatggtcctgctttaccacctgccttccccatccttttgcatgcttgcctgcctgcctgcctgcctgcctgcctgccttccttccttccttccttccttccttccttccttccttccttccttccttccttccttccttcctctctctttctctctttcacttttcttttcttgtgagcccagtaggaatgataagtgagatataaatattaaaagttggtgctaattgtttgcttgttcctcctttaggaaacagtctgttttaatgtgtgaacttctaggtcttttctatacttcttgaaaaaagttcacctaggcttcacacttgtcactagcagttggattagtgcttagatgaaagcttgtgccaaagtgaggcatagatgaagtaattttatgaccgtttgactctttctcccttataagttttgatccacaaaagaattaatttctatttcaaatgtgtggttgaacttttggatgtttttttcatttccgtagtgcaaattcatctttttcaggattagctctcatgggaaaaaccaagagctgttgggcatttttagtttatttatcaatcatgacatttgagtgctggatgacaatgaagttttgccaaggattactctgcagagccctgtgctttatttccattgttatctttggaatggattacattcacattatttgaggaataattaattggagccccaattcagaccagttggaagactaacaaatattcttttgttttggttacagaagctgcacacatacatgtaagagaagcaaaaatgtcagatgatatcaggaaaaggtttgaatttccaaattctcttatccaatcacaggtaattttgtttgtttatttttgctcatggtaacaaataaacctgttctgtggatttttaactgaactttatatatttaatattaaatattttattctacatgtagagatttatattttgtgaaacaactttaaatatacatttaatttgaaaatatatatttgacatggaaagcaaatatttgaaattgatcaatctcagcttctgtttatatatcatacttttcttcctagagataataaaaccttgattaactagtaggcccctgaatatgtttgtttggttttttttggcctatgattattgggaacagaggtaaacagttatatgtctgaagagtatgagggattaatatttaagaagacatatcctaccccttatatagatttttataataatgatatttaataagtaaaatatcctggattagaaaatttgatatatctactaagatagaagattgtgataactttaaagagcttttcaataattaaatagttaaaacaaagatggctttctgggtagcctttagctaactagaaacattctggttaatcaaggtatcataatagcttattgtcttttcttgtgagagtaaagctaacagaccagcagaagccatcttgaagacttaacaacatacagcaccttggatactttcaacaattaacttcggagatgtctgctgtgggaattgacttagctgggtagtggggaacccttccatgaggagtagaacactccttatgcaagattcccttctacctggctgggttggagtcatatcctgcaggtccttaccatgaagaagaagatgaaggcttggaggatactattcacagttttatttttctgtgcctggagtctctttgttaacatagataatcaagaaatgcccatacgtgttactgttaaattaggtgaaaaaaatatatatatatatttatattgtttagtgtaggatggctatttgaattctgttatagaacacttaagtagcaatgtaggctgatttatccttgggttttgtattttaaaaaatcagtttaggctagtatctctgatttgttagaagatgaagtgaaaagtatattagataaattcaacctggtggggaatggggaattaagcttctcttcttttatttctttttctagatatgaactatagctttttctttgtccctattgtgtttcatattagttttattaggttcttgtgattgtgtcctgtcctttgcaaatatttcttattgttcttctgtaaccactgctcgatgttagcaccatatttctttgattcacacacgttttttttcagattttaacatctttgaaattggattgcctctagtaattgatggcagcagttgagatacagttggtattgcctgcacatttgtgaacttgggcatgattttctacacgagtctaaaagaactcttgtgtgactataaaaccaaaattccgacttataagaagcactgtatatcatagactaattggcagccttttttctttcttagtggcacacagtataatggtgcaacttgcaattcctggtcagttccattcaatgaaatatggtatgttttgtaaaacaggagctcaacctatccatgggtgctcagttcttattactattccttttactaggagataagagacagtaagttggactaaacttaatattcatgtaaatgagtgacttatatcacaaaactagaccacaagcaccacggtcttaaatcagttccaatgtgtgaaatacaaagagaaaaatgaggaaggagtgggtgctgtgtttttatttgagctgttctggagactttgcaggactgacagttattcacagctataccgtaatttggtcccaagtgcaggatggacagttgtagcaatagtgaagtagtttccaacccgtacacagaatggcaatgattgttgctagcctattggctctaagacatattcttcatattcgttaacagtgtgatgaagcatggtggatttcgtttcagtgcaaagatgattttaaaaactatgggctttctcattcatgttttaatggagtaagcaatctcaagttatcttctgatactgacagcaatttgaaccaaaaatctggcagttttcttaacctctatgcactatagttgcttattggtaacctgggatagatatgcctaccttgagggctattctgaagattagaaattgtgcatgtggagtgcctaattcaatgccttctacatagcacacacttagttaatgggaattttacttaatcctaattgactgcctggcatactcatatcaactagtattgatatttggaaagaacttctaagggactgtgttcattaattttatttctttttaaggctgtgggtcatcttattgctgcagtcctaaaggaaaatggtttttcagaaaagattcaccaatctacaaatcaggtctgtgtttaactttatgctttaattctcttcagataagattgctactagctggatcacatatgcacctgtcttgtttccctgatagttcagatcacagtagaaatgcttttgaactgtgagaacttcattgccttttttgtttatttgtttgcctttttaatatatagcaataaaaaagttttaaatttattaaaaccctctaggaatgagacatggagggaagggctggagaggagtattcttatgactattaatgaaaaataatatgggtggaatgagagaaagcatgctttagagaagattgatagagttacctctgagggaattattttggtaatgaagagaatgaacagagtggctctgtttggatgtagatttctcatgcttcagctcagccccagctgtgagttcttagttggaaaggtcatacattgacagtcaaagctgaaaaattccatcttacacaaatagcaggtgaatgctcagagttgaagcaatgccagcttactgagatacacttggggtttggttgatcagtgttgtgtgttttgacctgctagttgggaaactcttcttttaagagaggtgttctcaggtgtcctctatagggaacataagtgatggaaataagattcttttttttcacagcagaaataaattgatttcctttgtctcacattctttttgattagctgctccaagttacatttctttattgcttctgcagacatgttgaagtaagtgtaggacacacttcactaattggcatttttctggtgtttgtatgtagtcatataaattaggttttctgaaaactctgatcctaatcctgcctataatcacattgtgtactttgagaagatctagtgattttacttaaactgccaggatttattgaatgtcaaatccctgtaactgtttcctcttctactaaaaatgaatgcttacacagtcttacctgaggcagcagtttatttatttgtttgttttgtttttccggtgtaataatagagtgatgacatttagaaccttttgatattgtcagtacagctgaacacaatgtccttatgaataaaaggagaagtggaatataaatatttccttcctgtagtgattgttaactgtattgttattttaatagtgggatgctaagatagaaaagattcttagccagctacagagggaaagtgggtacaaaatgatgttgattttcttttcttttttttttgagacagagtctggctctgtcgcccagcctggagtgcagtggtgtgatctcagctcactgcaacttctgcctcctgggttcaagcagttctcatatctcagcctcccgagtagctgggactacaggtgtgtgccaccacacccagccagttttttgtatttttagtagagactgggtttcaccatgttggccaggctggtctcgaacttctgacctcagttgatccacccgccttggcctcccaaagtgttgggattacaggcatgagccacagtgcctggccttgattttcattcttttattaatagttattctttgggagccgggatattaatttttcccaaattatatatttccctaataagttgcatcaggaaaaaggaaaaattgcttcattatttgttcttttttttttataatacaactgtgtgtaagtctaaatggactttatctgcaatatagtcatataggtttattgttagtagtgaaccattttggtggtcctggattcctgagaaagttataaaagctagaacccctgctttgatagggtattctaaaatgaaaacttatatttacttatatgtccttctcatgctcttctatcagtgaagacagagtcacagtgtgagagggggaaagtcacagtttctttcttgggcaaacagttttcctaggcttttttttttttttttttttttttggtagccatggactgagcagcttgctggtggcctgtcctacttctctctttatatctgggcccacgttagacttcaagaaattgtggcaagggcattgtgggtggtggtaaggtgcatgtaggtgatagaggttggtagtaggagagaaggaacatcttctgaaaataactgttattgtcattgaaggcttatggcataaatagtatttggagttcaactcaggctagctgatatactattagtgtctggttaaattgtttggttagagcaatgtgctagagccaagttttagctttgttgtgttgcttgaactcgggtcatacctctgcctgcagccagccttgttttatagccatgataccaggtgagagagagttgctgtatcaaaacacatccattacctctcttggaaaattgacttcattttattctaggaacagagtgacaacagcatcatctttataaaggaaagctagcctactgtgaacaaattactcattgatgaatgaccaaaggtgtgtgtgtgtgtgtttgctgctcatcagaattgtcttctaatcactggtttggtttcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccaggtactttttcctcagtgtttggtcagttaatgatttaagtttttaggaaaaaaattcactaaatcactattaagagtcagcattcatcctacttgccagttgtttttcttgctcttaaaatgtcatgagttgctgtttcatatatgaaaatatcatgctaatttaaaccctatagtttcagaatttgtggtcatttgcggtacttaagttttggggctctacttaaatttgtcgttgccctttttaagaagaaaatagctaaacagtttataattcaaaaatgtaatgcagattcctgacattttaagaaagaaggttgtccataagcaatgcttcttccacagtggtatagtttatacattgtagtggcattacttggccaggccttggcattagtgtattagaaaataatggcatttatttctcaaatattttgtgatttagggatgtcttccccctgatttttcaaagttaataatgttttgttctttgaatttgtttggtatgaccatatttcgtccatttacagactgaggtaataggacaataaggaataagagggttccattcagaaatggtcaaacaggaccatgtttgaaccagtgagcctctgttataaaatactccctgaaaaagagttgtcactctttgcttcaagaaattgtcttgatctatatgtcctaatttttgactacttcaaatcatttgggcttttgcccccttccctcacctctcaccaagcctccctcctccttggtgaagctacttgtttttccagtgtttttcactcacctttattatagtatcatcgggctgagtacttaatttttttccctgccttcagtggagatggagtacagctgtaattatcaatttgtggaaagatgctggatgcagtgggtcacgcctgtaatcctagcactttgggaggctgaggcgggcggatcacctgacgtcaggagttcgagaccagcctggccaacatgatgagactgtgtctctactaaaaatacaaaaattagctgggcgtggtgatgcgtgcctgtaatcccagctactcaggagactaaggcgtgagaatcacttgaacccaggaggtggaggttgcagtgaaccgagattacaccactgcactccagcctgggtgacagagtgaaattccatcttaacaacaacaacaaaaatttgtggaaagattcctgggcttgaagttgattaggttaaataacccctagccttttaacctttctttataaatcgtttcctgtttccttagatcatttctttgtgtctttttggcaccttggtcttaattttgccctgttctgccctgccttcccctcccctccccttcctccccctcccctccctttccttttccttccccttcctctcccctccccttcctctcccttcccctcccctcccttcttttttctcccctccttccctccctccctccctccctcccttccttccttccttccttctttccttctccctctctctctctttctctctttctttctctgtttcctttctgactgggtcttgctatgctgcctgggcattattgtagctcactcaagcctcaaactactgggctcaagtagtcctcccgcctcagcctcctaagtagctgggactacaaatgtgtgccagcatgcctggcttggtttttcttttccttttgcagtctgtggttgcaaaaggaaaagcccttcccaaactagatccagccttctgttcaagttatgtttccccccatgaaccctcttctctagacatccacaactcttcagtcttcctgagcccttgtgtgtgttccacaccagcatggcatgctccttccccttctctgtctgacatcatctttgttatcctttcaggctgtgctcagatgtcctctttcctgtccagacacttcccacttctctgctgcgctaattgttgtttcacagtatgtgcctatgtgtgttatttttaaacctgtattttggtatctggcactctctctgacacttagtagatgcccagatatttctgaataagtgaaggtttgatcatgactgaaaacttactactttctctctttctgtttctacacgcattcacatacacgcatataaacacaaaaattttagaataattctattgtataccaattaaaaaagtagttttgaggagaattttgaaaagttaagatttttatgtgtctcttgttttctcatttattggttgatcttgtgcaagccacctagattttaccttaccttttttatttgtgaaatgcagggatggtattttttgccccccaccccacatattttcaaatgccttaaaaatctgcaaatgtaaaatgtaattgcattgtgtagttgtactatttatattcaaaagttaaagtatcagcagctcatggggccaatgtagtatcttctgtgtatttgaggtgtaattagagcaggttagattatacctttaattctagaagataatcttagaaaattatgctggtgtgaggtatcattcacacatcagtattaattcttcctccctattgtaaattgcaaagtataagctttgcagatagtgaattatcctgtcatctctgcatattataatttgtgggtaaccttggttatttttaaatttaaaaatgtgttttttgggtgaggtgcggtgactcatgcccgtaatcccaatacttcggcaggccgaggcaggcgaatcacttgaggtcaggagttcgagaccagcctggccaacatggtgaaaccctgtctctactaaaaatacaaaaattagccgggcgtggtgacttatgcctgtaatcccagctactcgggaggctgaggcaggagaatcactcgaacccgggaggcggatcttgcagcgagctgaagctgaaattgcaccactgcactccagcctgggtgacagagcgagacttggtctcaaaagagaaaagtagtgtgtttttttgaatagataatatattcacattggatattttaggcaaagcctctgtcctatcccagtatctgtgttttatcccccctgtggaagacaaactgttagtaggtcttattatattctatgtaatatataatagaaaatttgtatgtatgtgtatttacatgtatattttccttccttaacaaacagaaatagtagcctattacatagtattctttagtttgcattttcagtgaaaaaatatatcttggagcttgtattaggctgttcttgcattgctataaagaaatacctaaggctgggtaatttataaagaaaagtggtttattttggcttacagttctacaggctgtacaggaagcatggtgccagtatctgcttctggcaagggcttcaggaagcttacagtcacggtggaaggcaaagagggagcaggcatgtcacatggcaagagccaggagcaagagagagagggggaggtccaagattcttttaaataaccagatctcatgtgaactaactgagcaagaactcacttgtcaccaaggggatggtagtaaatcattcataagggatctgcctcccgtaattcattcaccccctaccaggcctcatctccaacatttagaatcatatgtcaacataagatttggaggggacaaacatccaaaccatttcagaactcattctataaaatatataaacagctttctattttttttctagctgcataatattccattgtgtggatgagccataatttatcaatttcctattatttctaatcttttacaatagatagtgtttcagtccttaatcttatacatataggtggccataaatttttaaggttctttggctatttggccaacatgtggaagaaagccttgaattttataataagcaaatataggagttttaacagtggaaggatgctggacattttaaacaagatttcttatctgagaatgttcatattgtctaaattgtcatccacagggagatatagacagaatagatgctgaagctaaccaatttaatttttgaatcaatttgatcataaaatatataagtgctaagttttccttattgttgccagtggatataataattatttttatgtcagaaaacgtaattttcttcatttgctttatttcaagtagcagaactttgcggtgtgtagtgaatacgaagactatactttgtaccgtttatgtttacaaaaaaaaaaccccaacaaaatgagaatccattttaagaaacaagctaattaaaaacaagacactcaaatagcctcctcctccaaaatgaacctcagggaatcttctgagacagaaaaccatctgtgtctttgggacttaaaggcaagaatgggccaggcgtggtggctcatgcccgtaatcccagcactttgggaggctgaggcaggtacatcgcttgaggtcaggagttggagaccagcttggccaacaaagtgtaaccctgtctctaactaaaaatacaaaaaaaattagctgggcttggtgacacatgcctatagtcccagctacgcaggaggctgaggcaggagaattgcttgaacctggaagcagaggtagcattgagccaagatcgcactactgcactccagcctggacaacagagtgagactccgtctcaatcaatcaatcactcaatcaatcagtaaaatgcagggaatgactttgggtgagacagtttgggtcttcagtttccattatttaaatttctacttgtctctgccttctctttaattagaggtttattggaatctaaaggcactttgggaactgagacacaccatgattgcttatctttgctttagaaaaatgattctaaaattttatctttccatcttgcctatttatcttctagcctactatccttcaggaactgagaaagagagaggggggtggatagaaaaagccaatagtgagaaacagccttctatagaatagatgtttagagaatgtagcttattgaattttttcagcatttagagcagattttgaaagcgtgaaagaaagatggaaggaaaagtagatgtgcccatctcttccagccttataacttgctccttcatcctttgtaagtctagtctataaaattcctttggaacacgtatggaagcccgcctcccacctgaatccaagcccacaatttgagaaacagtggcttagagcgggttacattgtatagtctaactttgaaaaagacttgacatttgcaatgatctggttgtctaaacttcagggagtggctgggaaagggtctggctgtgcttgagagactgttctcttcaaaggaatagtttcatgtcctagagtgttctctgttcaaagctgaggcaacatgaaacaattgtaaactcgtttttatagcttctgtaaacaaagaaatggatttaagagctctaaaatgttcttttcatcagtaaggaaatttgaaaaaaaattattccctagggagggtgaaggaaagaaggggaccacaaaagaaacacagtaaggaaatcattatcaccagtcgaatgtgaattttgaaatgaaatgaaactgaaaataaagtgaaagatatatagcagcatatagttttgtacacctttcaggaattgttttgagtttagattgtttttggttttgtttgtttttgtctttacattgactgtatcctggaatagagtcccaaaccatttttctttccttagaatttttttccccttaactgtgctggcttctagaaggctcatgcaaccattgttacagttgcttagtaacaggattgtgaataaaaaatcttgctctcctgcggaaccaggtattcagttttgatactgaggtgtcatgacagcctgtaatttcagctcaactgcttcccccatttcttgtcttaatgtgcttggtaagaaggttatactctggataaaccaggctagcacttgatttgtatgccttttgtgctctcagacagggaagggacctgcattcgaggtatttgggaatataaagtgtattaaagtgtattttctgagacttctaaagtctaccttttaatgaaatttagcataggatattaaaaattcttgtagtgggtcctaagtaaagctgttggattcagtgagtctttgatcatgggctgatgaaggttcagtggttaaaaatgattctgagaatcatttggagttaagatttaggatgatttatggagaaaattcttgtctctcagggtcttctcttttattgatgaccctgttccttgggaaacttaattgctttgttatgtaggaaatggctagcaactgtattcatatcttgttacattattgaagcttttctgtattatttagcttctttctctttattttatttggcaggagaagaagaaccaaggaaggatgcctttatgaggtttcctccaaggtttagggaagacagcacattttaatctgcagctggggtgtcagagcattactatctgaatttgatgtggtttcaaggtttatatttatattgatattatggcttatttaacttttagtagagagtgacagagttgctagtccatgtctgtttcccatcttgtcttttaaatattccttttaagcttattagcttgtttctagatgttctccttccttttgttccccaatccttttttttcccccttgaaaatcccagaatttctctcaactttcagttcctaatcagaaaagtggttccagccacttttctgatctagcacattctgccctatttctttttaagttagttgatctggttgaaggctttgtcacaaaatcttccattgtagagtcatgtatttatgctaagatgtttctaggtgatttaagaacagtggctactgaacacatgttacttttataatggaaaaatgcttcagaagaaatcaggccatttttggtacatggaagacaaatgagtgcacagaactttgttaggcaaaagctcagtaacattacatctcttagattttattttaaagaagcatttttttggtcattcatttaagcatggatttctcagaactgtttattttgtccgtgtcttcttgtctctgtttatctctttcatatagttttatagttttctcatatagttttataatgaatttagacaatgatttgattatttttctagtgtttatcattctcttgtttgctgatgacttactatgcttaagactgatgaattatcttgttcaggggtctgaaatcctttccagttaaaaagggacttggccacatttgttcccatgacacctagggatgcatccctcttgggatgttatgtcattctcttcaacccaaacccaaacccttttaattctacccctggtcaaatatgggtacagtcttgtacctcatgtttggtatattttgaaagcaaagaatcaagcattatttgtagtctttgaaaaagagacccagcatacgtgagcagtgtttagtgttgtaatgaaataattcccaaagggaatctgatacatgttattcatatacacagtagtaattatgccatattaacctagcaaaaacagtctgcctgagtgttttctagttagtgtagttggtagagcttgactaaaaattaaaaaaaaattttttttgaatcttcaacgtcataattgacccatactccctctcattataggctaactatcccctgtctgaaatgcttgggaccagaagtgtttcagattttatgttttttggattttgggatatttgcatatatataaagagatatcttggatagacccaagtctaaacacaaaattcatttatatttcatgtacaccttatacagatagcctgaaggtaattttgtacaatattttaaataactttgtgcatgaaacaaagttttaactgtattttgtctgtagcctgtcacatggcttcaggtgtggaattttcaacttgtggtgtcacatcagtgctcacaaaatttaggattttggagcatttaggattttggatttgttgattagggatacttagtctgtatgagaggtgggtcttggctcttatgcctagtgaaaattgtggcacctttttgcattgtctcttgctactgtgcttgtggcttagttttgaagtttcctttgctctctttaagggttcttgagtaaattcatcttttcctggcacctgcccaagaaaggacttattccagctgatctttattgtagacttttggcagcagtttcctgtgtggattaggtctctttgggctaccagttacagaaatccacttgaactagtatgagcaaaaatggattaatttttttgataaaggagtatgtatctcataggacccaagaataaatatgcacctaggcctcagaaacaaatgggatataaactgtgtgttttgttcttctttcttcctgcagactttctctgcctcctagttcacagggcaccacctgcccctggcttaacatctcttgtatatgaggcagccagactgagattggaatttcctggccacaattacagatttccaatggtgggacctggagctggatcagtcagctctgccaagtgttagttttctagggctactctaacacaagatgataaacttggtggcttaagacaacagaaatttattatttcatgatttcatgatgccttgcagccaaaaaccaaggtgtcagcaggactgattccttctggaggctctgtgggggaatctgttctatgcctttctactagcttctggtggttgatggaaacctttgacattccttgccttgtggccttgtaacttcagtctctgcctctgtatgctcatggctgacttacctgtatatctctttgtctccaatacagtatccctgtactttctctataaggataccggttattggatttacgacccacctaggatgatctcatcccaagatacttaatttaattatatctacaaagaccctatttccatataaggtcacattcataggtactgggggttgggatttagatgtatcttttggggggacacaatttaactttctgctcactgtgtcttgattgtgtgagcatatgtgtgctaggatcacttatacagtaaccatatgaatgcagagggtgtggtaatttccaaaacagagaggagactggaatgctattcctgaggagtcctctgcactggaactgaatttggaggagagccacatggaaataggtatttctcagcctttcagctctagctttgaaacataattgtgcttaaatacaagtgactaatactagatctatgttgctcagacagggatagaaggaggagagattgagtgaatggagaatcagtgtcaaatataattgtttaattgtggtggtgggatactgccttgacttcccccacctcccagaatattttctttaaattataaattatctctctaaacagcaataataatagaaacaaccactgctttgttttctaggggaagagggttaaggaagaaaactagcctttcttgaatataaactgtgtgccctgccttgtgctttagagctttacctaaaattccccacttaagtctcaaaacaaccctgggagtttgggggagactttttcttaggtgggattgtgttcttttctcaggaggacatagtatctgattgttttcatttttgatgatgttagcagctgttgatgctcagtgactagatccattaattcattagggatttcaaatggtgacattctaattctatgttttttttcttcacttattacctgaaatacttctataaagagaatcttccccatatctacacccagaggtataatttatataggaaaggcaggatatatatgtaattcttttatttactaaattccaaaataatgattttttaaagcatcctttcagtggtgaccagttacattttcttataaaataattataatgagcttatggatttaaacatacttgatgtatttcagtcctcttctcctctatttttaaggctgtttttggatccactctttagaagcagcttgagagaggagggtggaatttacaaagtttcaaaaatcttattgctattcagtgattttcatatataacaagtgagttaagatggaggggagtgaaagaaacagcatcttccaaataggacttcttgccccggtcttaatattaagtcataggaaccatctaatattcctaagactctcttaggaattaatttacagggtggtagatttagctatgtcatgggcaatcctcatagcagttaaatctctgcatacatctgaatatttctctcttacttttcttattccatcaggaatcttaagttggttttaatgttgtaggaatgtagattaagataagttaaatgaaaaaaaaacccataacaacaaaaaaactactttgatttctggctgagcgcagtggctcacgcctgtaatcccagcactttgggaggctgaggcgggcagatcacctgaggtcaggagtttaagaccagcctggccaacatggcaaaaccccatctctactaaaaatacaaaaaaaattagctgggcctgtggtgcgtgcctgtaatccctcctactcgggaggctgaggcaggagaatctctcgaacccaggaggtggaggttgcagtgagccaagatcgtgccactgcactccagcctgggtgacacagcgagactttgtctccaaaacaacaacaacaacaacaacaacaacaacaacaacaacaacaaagtacttcatttcccaatagaattcattgcttgataatataaggatattacatgaatttcatcttcccagtatttacagttatcctatttgctaaatgtgtgatcccttaaatgaaaggccttttagaaacacaaccagtaatagcattcatattattttgtaaaaaactaaataatgaattttgatattagagatcagatacatgaatttcagtgtgcatctataaagttatgtaaatatagaactagaaataccttcagaggttaccttgggagccaagcaagatagtacctgagctgtatccatccatccatctattaattaaacatatatttatatgtatttttttgacacagagtttcgttcttgttgcccaggctggagtgcattggtgtgatcttggctcaccacaacctctccctcccgggttcaagcgattctcctgcctcagcctcccaagttgccgggactacagacatgtgccaccacccccagctaattttgtatttttagtagagacggggtttctccatgttggtcaggctggtctcgaactcccaacctcaggtgatcttcccgcctcagcctcccaaagtcctgggattacaggtgtgagccactatacctggccaattaaacatatttattgagtatatttatttattattttatttttttaaagttctgggatacatgtgcaagatgtgcaggtgtgttacataggtaaacatgtgccgtggtggtttgctgcagctatcaacccatcacctaggtattaagcccagcatgcattaactcttttccctaatgctctcctgagtatatttattatctcttgtatttctgtgctaggtgctgtgataccgtggtgaggaatgcagacgtagttattgcactcatgatgcttttggtttcaatggagagattgccataattgcctagttatagaaactcattcaaagtatactgtgttgggaatgcctttaagatgacgatttgacttagtcatggtggtaaaagcaggctttcctgaggaagtgacacctaagatgagacgaaggagtaaataaaagttgtctaggcaaacaggagttggtaaaactttccagttacaggaaatagtatgtgccaagttcctgctgtgggaaggagattggctgttaagatggcctgaaagaatgctaagagtgaggggagagtggtatgaaatgaagctggaaaggtaggtgggattcagacagtgcagcgcatgattgacaatcttgatgatttgggtctttatcctgggtggagaaggaatgtactgaagtgttttatctagcgggtgttagtgattccacaaaaggccatttggaatgcagtatgaagattaaaatggaaagtattgggtttggggtaggcacctagatgggatacacagagattaggtggctgttgctgtagtcgagtgagaggtgatggttgcttgcactagagatgggggaagtagagggatttgtgagatatttaagggatgaagcattcgtggtgtactgaatatgtagatgactgaaagggatatgtcaaaggtgactccttgatttctggctttctctacatttagatagggaacattagaagaccaggtgtgtcgggggagagcatgggttcaattttggatgtgttgaatatgaggcacaattcagatgctgaagtggaaatgtctagtaggcagctggatatgcctttttttgttgatatcccctgaacacattatactatgaataagttaggcataatatctaatcagctcttttttgccctgattaaagtctttaccttgatttgttaattaactcttccgggtacctgtgtacctcaaactcatagagtctgcttatctaaagtctaattccagtccctaaaaatgttcctcagaaatctgctttttcaaattaaatgacatgtttttgtgtctgtgctaaactgtgactgaatacaggtcctaagcagaagacaccgtggttatttcattgtttatttcaatttctcctcatactgtctatccaggagatcacgtttaatttttcttttttttattattattatactttaagttttagggtacatgtgcacaatgtgcaggttagttacatatgtacacatgtgccatgctggtgtgctgcacccattaactcctcttttagcattaggtatatctcctaatgctatccctccccactccctccatcccacaacagtccccagattgtgatgttccccttcctgtgtccatgtgatctcattgttcaattcccatctatgagtgagaacatgcggtgtttggttttttgtccttgcgatagtttactgagaatgatgatttccagtttcatccatgtccctaaaaaggacatgaatttttcatttgtgttcaggaagtccttcctcactgggccaggcacagtggctcatgcctgtaatcctagcattttgagaggtcaaggcagaaggattgcttgaagccaggagtttgagaccagcctaggcaacatagtgagactctgtctttaaaaaaaataaaaaattagccaggtatggtgatgcacacctatagctccagatacttgggaggcttaggttcgagcatcacttgagctcaagaggtcgaggctgcagtgagctatagtgagctatgattgcaccactgtgctccagcctgggtgacagagcaagaccctatctcaaaaaacaaacaaacaaacaaaaaaagtctttttcgcactttgagattataaatattttttaactaatacaaaataaaagttgtgcaaacagtggaaattgtaggtaatggaagtcagtggtgaaactactttttgtcatcttttttttcttttcttaaaattcacttttgttattgagccctggtgaaaagtaggaaatggcaggactggaaggactcagggctaatagggagtcttaaaggttccttcaaatcttggtcttggtttctgctaggatatagagaaaaccagggtaatctgaagtcagatccaggtacatggaattaggaaccaactaaccccagtgacattgaaatcccattcctagacctataaaaaacatttatatgcacatatgccaagtgttttagaattgaatattccgttcaaatgtattttgtttttaaacttgcatttttccacatagtatgtgatggtaatttttccatgtcacatgcataaatctgtttgcaaccttattaacagctgtagagtattctgtttaagaggagtcacattttagtcattttcctaatgacagacatgtgtttttttctcttcctctttaaaagataacacatacagtataatattgtcttttttttttcttttttgaggtgatctcactttgtcacccaggctggagtgcagtggcgtgatcatggctcactgcagccccaacctcctgggctcaagtgatcctcccacctcggtcccccaagtagctgggactacaggctcatgccaccacacttggccagtttttgtattttttgtagagatggggttttgcccagtatggtctcaaattcctgggcccaagcgattcgcccaccttgggcctcccaaagtgctgggattataggaatatcttcttttgagtatagataagggtatgtctataggatggggtcatagaagcagaatttatgggaaaaggggtataaaattttcatagatactgtcaatttgctctgcacaaaggctgaaccaacatatcaacatgaaagtgcttacttcccccacctactctttaacactgagtattatgaatcttattcttctgtgatttgtgtatctctattctctgctcagtttgctattttatgatctgctttattttgttgcttttcttgttttgtgggcatgtatgctgtaaacattttatcttagactctctcttaactttgttttcactctgctaaaaactttccctaccaactttgctgaaactatctggaattttagttacagatttttctttttgttattttttacattttttctccataaattctttcaaagcaattgctttaatctttatagtcacatttgaaaaataattgtatgttctgatattcatgcataccaaagttacttgtagtctacatgctttttatttcttcagtcaatccttccttccttccttccttccgcctcccctcccctcccttcccctcctcttttccttctcttttccttccctgagacatgtctttctgtcatccaggtttgagtgctgtggtgagatcatagctcactgtaatctcaaactcctgggctcaagtgatcctcctgcctcagcctcctgagtagctaggactacaagtgtgtgccatcatgcttggcttattttttaaggttttttttttttttgaaacgggatctctctatattgctcaggctggtctcaaactcctgacctcaagtgatcttctggcttccagccaccagagtagctggggttacaggcacgagccactatgcctggcctcttcaattgttttatctttaaaaaaaaaaataacagcttattgggatataattcaaatattataaaatcactctttcaaagtatgtaattcagtgttttcagtatagttacaaggctgtgcaatcatgcattctaatttaactggagaacctctttaagaaaaattttcagagttttatgtgtgaaaatatttcttttctggtattttactcacttttttgggggaggtgtttggacttactgagttttataagcctttctcttataactccacatgcattgcttcattcagttttgttgtttgtagacaagaatgctgatgccaaattagaaatgatgcaagcctagttgtttttattttatgaatttttttgttttataaaatttaagaggttataggattttttttatcctttgagaaatgtcagcaattattttatttcagaaatcttgcttagtacttggaagctttttcaatttgaagatgtaagtgcagtgaaattttctttgacttttgcttctccagtggttatgttttcttctaattcactattttgagttttagcatgattcaaattactgtaacctctttatgaaatcatacagaattcaacaataattttcattttgcaggagtagatctcagatccagaataacaaagacttgaaaacaagaaaagcagattttgagctaagagatggaaaatactagagatttttaggagttaggatgagtttgtagttagttttaggcaaattccaggcctcagcgttcattaactctgatgcctgtgcttacacagcgtcatctgaaagagggaagaacattattatctttatgttatagtataagttttgaattatcccagctttttgaaaaagcatgtaatttactgacatactattctttattttttaaaacaacgtaagagatgggcttattatgatttttgattatgaagacgaggatgttgagacccctaggcattaagtgacttgcctaagattccctagttaattcaaattgaagtaggggtttaaataaatattaacctgaaagtatccctctcaacccatttgaaatatgtaaatcataatatttattaaacataatatttattaatataaataatatctatttcaagtgggttgagggggatagtttcaattaaatttaaggcaaatgtataaccatttgaatggcgctatgtgtaacttgattgatgccatcatctttcaaaaattataatctactcatgctacactcttgctgaaaatacagcattgactccgttatctacacaataaaatctggatccacagataagagtaagtgagacctaacttaaagtttaaaaaattggagttcatttatcagcattggtggttttgtgaatcccttggaattaaaagtaaatgtgatgtctattcttttctcttggattccactgctttcataaaaaggtaggacaccataaaaaccatagatctgttatctgttatctctagaactctagtcatatgacaaataaataattaaggaaaaccaatatagtttcacatgcaaaaaaggattatttaatgaatttgtattttttggaagaaattcagtcagaaattcatcaacactggtcatttcaactaatcattaggctcagagtgcagtcttacgaggttactaggtgaagcctggcctttcttcagtggtatataaatagcttaaatacgacttgaaagctgattttcagttgtatagacattgaaggctagaagataagaatgcttctaaacatgtagtgactctttctccaggacagaccaaagtagactccctatgataggctttagtcagatactggattctcagaatggctcacccaattagtgatgatgagattgtatatttcatggtatcatttaacatctaggcacaggcctgggtcagagctgcaggactgcatccctgagacctggtaagttagcttacaaaattcatatatttggaggagtcagatcccatagaccttcagaggaggctgtgtgaactctaccctgtgacttagtcgagacatttatacctaggtataggttcttgataaattggtgatagagcagttatgttgagggatctccaggtctttgtaaaggaaggtgttgtgaagagttgtgaagaactggaggatatagtgggagacaccagtccttatagtccagagttctcagttacaaaaagttctgattctgaaaaagtaaatggtgtgaagaattgcaaagaaggagtttattttaaaagtttggatgttgaggtatctttttcctaagctctggcataagaggagtctagaaattcagtgtcaatagagaagtttctcagaagaatgtgaacagttccaaaggaagaagacaaggcaataccttggttacccaaggaggtcctcaaggagatgccatgcagtcagactttcttgaggcaattacacttcattctagtttacaaaaagatttccattttaattttcactgagttacagtgagattcactggccattttgtgggccaaagtaccatagaattgacacagtaccaatgtgtagcatgtgagcaagccaaatcttgatttgacatccattggagaacacacacaggagagagaatctttatggagaaggcttcatgaagtgttgggacctctgtgttcaccagaggatccacacaggagagaaactatacacatgtgacatatgtcatgaaagattcatccatgagttatactgaatggtcctaagaggatccatatggaagagaaaacataccactgtagattgtgaaaaatgcttcagctgcaagagaaacctcaatactccccaaagaatccatttaggcactaaactatttgagtgtctacagcagtgctgtgaaatagaaatataatcttagccacaaatgcaagccacatatgtaattcagaattttccagtagccacattaaaaaaccagaaatagattacattaactttaataatatattttatgtagcccaatatatcaaaaatattatttcaacatgtaatcaatataaaaaattatacatggtatttaatattcttttttttgtgtcccaaagtcttttaaatctagcatgtattttgtacttacaggacatctgaatttggactaaccatattactagtgctcagtagccacatgtggctgttactatattggactgtgcaggtctactaagtggccaaaccttttgtcacttggaaaaccttaaatgccataaaaaaatacactcagtaacatctcacataaatgccacaaatgatacctaattaagtccaagtagtgttctaacccaaaaataaagttaacattgatttctaatcaactatgttctgaagtaagtgacataatgcaagaacttagaaaagtgcttagcttatggtaatgctcaataaatgttaacaagcataattaaacaataattactttttggctgggcacagtggctcacacttgtaatcccagcactttgggaggctgaggcaggcgggtcacctaaggtcaggagtttgagaccagcctgaccaacatggtgaaaccttgtctctactaaaaatacaaaattagccagatgtggtggcacatgcctgtaatcccagctacttgggaggttgaggcaggagaatcagttgaacccaggagatggaggttgcagtgagccgagatcgtgccattgaactacaggctgggcaacaagagtgaaactccatctaaaaaaaaaaaaaaaattactttttaaatttaacaaatagtgagttttttatttctaagattttctttatattttccagggagatctttatttaagaaaggcagcctatttttctttctgatatgtttatcctcttatctcttacaaaaataaggaaaaaatttaaattgctattccctttctattagctctatttcgatgggggttatttgctttgattgcttccctggcccactttttagagtggctgatccatttcatatatttggttatttttcatagtctgctaatatttataaatgaaatatttggtcattcggtgtgggcaaccaatgtggtcactgcttgaaattatgtgggctaatgtttgttttttcctgattgattttcccccaagaatgtgtaggcagatgattgataagttggtggtttgattctttagctccatttcttctcctttaaatgtgttggatgggtttgggctgtactatagaatgagttgagggcctgtgggtggctactgtttaatgtgggtggcaagtattaaaattattttaaaatgataggattaagcacctgattagaatattcactttttatctataacatttaacatgctatatttctttgcagaaatacacatggcttgataaaagccattatgcacttactacaaatgcaagctcttaaggaaggacaaggtggggaaaagaatattcagagtatatataccattaggtaagccttttttctgttttttttttaaacaaatatgaatttttaatgaaattattaactgtgacatgataatccagtaagaattagttatttaattcagcaggatatgcacacagtgattgtgggtgttgacctctcaggaagttagcgtttcaaagactcagaggattgagatagagttgacaagatgagtatcaccaatgtgggtttcagggttgctaatttggaattgaaatcttttacctaaaactcagattattctgtttactctagaatatgtaaccatcttcacagtattatgaaaatggaagacttcattgaacaaagatatttaaagcagggggggatttaggttaggcaggatggtaatctgccttactataaaaagcaataggagactgctatttccaagtgacttaggccaaggtcagtagttaggagtgttgatttgccttttctttgtcatctgtagaatgtaataaggtagaattgttttaaaaaaataaaatacacacagtagcaataatactacaatgcattggattttctgggggagttgtggtcaagggagggaatcatacttccttgtgaaggtgaccttacctattgccttgaaggacccaggaagccatctcttaagagaggggctctgagttagcagaggacccagaagatgcatgtgatcagtgtatgttgccctaggaactctgttcagtgaggcattcagaatgtgtctgcttcaaaagaatgacagcatggaaccataaagaagggcattgattcatgtggggaagatggcttacatgggctatggtgatcaaacagggaaaggaaatcaggtacttttgctgtgagccaccactgaattgatcttacagcacctgtagtcttcagtatttgacaacacaggtatcagaagtgtgagagagtctctcttcaaaatacagaggggtgtctatcacttacctgtatttatagtgctttctttttgataataagtaaacagtatctcatatactgtaaatgggatggtctgtgtcgtggtatatctcatataccatgatcttccgtgtaatttttagtgctatttgtgatctcttatttttatgaatacattattgtttcttaaggcatttttttaaacaaagtcatatttgcattttatattttttcttaacatattttgtgaatatcttcaaacatacaagttggaagaatgtggtacaatgaattaatttatttttaaataagggaagcaaaaggaaaattatttatttgaaaatactatgaaaacttgaggtctgcagagtaaagctttccaaatcggtaaatatgcttttttttttttttttttttttaacatagtggtgtcctttgtgacgtaagggtttattctttatccattgccttggctagaattgaacctgcagagtaaatgagcacattttaatatttctgaataaacatctgcatttcctcctttttaaaaagaaattcaaactcttgggccagagttcaggatagaaaataattcaatttagttgttgttaagatgggcttatttatttctaaatagggaagctattgaagtttttaattgaaatttttatgtaacagttttatggagatataattcacatatgagtgacccatttaaaatgtatgattcagtgacttttactccattcacaaagttatgccaccatcaccataatcaattttagaacatcttcatcatctccaaagaaattccttaccaattagccgtcactccatattttctcccctctcagggaagtatttttagttcaatgcttcccaacattggtgcccattagaaccacctgggtgtgcttaaaaagagacaaacatggtaacgatcaaataccctagataaaatgaatccgaatctccgccatgaggcctagtggttttaaaagtgtcctaggtgattgtcattcacaatgagtacaaagtggtgtgtcagctgctctaaaatgtgcatcctaattacttggggaccttgttgaagtgcagattctttttccttagtctagtgtgggctcaagattcttgtctaacaggctcccaggtgatgctgatgctgcttttgccctaccacactgttgagtagcagagctaccgccgcatcggcatacctgtgaacctgtgaagaatgcagaaccttggactccatctaagagtgccagagtcagaactgcattttagaaagattttctacgtaatttataggcaccttaaagtataagaagcatcagtttagatgatggtaaaaagaagttttctataatgcagagaatttgggttactctcattttaatcctgattgtcttcaccgtgtgcaattgttagacctttaattatctgtaatgtttgaccttttaattcattttttcctatagttggttcctttaacttcagtcttgtttcaaaaggcaattgctgcaaggtgtgaataggaagcctagtttgagaagctgagaagaattggatacataggcttgtctttagatacgtggcacattaagaggtccgtaatcaatcacctgagttggcataatctggtaatgtttatggagagcccttatgtgaatggccgtttagcactataaatcagtagagagtaattgagtgtataagagccttaagttcctccaagggggattgtggatggcagaaacagaggagaggtgagcctgaagagcatattcccctcaagagagctatgattacctgagtcaatcataaaattgtcatgctgttttagagccttctttgccacatgttggttagcaatatcatccagccttagagaggcaactgatgagctgtgtatgaaagcataaaagggatatgagaaacttagaactccactgagaggtgttttctggttattctgtaggattaatttaaaatagaaggagtatggcaaataagtgtaagctttctgagcatgcagctaatctgtgtttttatggtattaagcactgtgccagtattcagctggggcttaagtatttcttacttctttttcttctaatagctgattaatttgaatcacagtgcaacagaatacttggtcatcttaaatggtctgtgctgaaccaaataagttgtaccagtatgggagtggacagaaaacaagagatatgagaaccaagaatgttaggcggtggtttcccttagcccctctgaattttatgaaggagctgtagagatggtattctttttattgtacctagagcttagttagtggttctcaaacttgtcttgcataagaaccactggggcagcgtgttaaaagtacagcttctgaatcccacttgccagagattcttattcattcagtgggttttgtgtgaggctcagaaatcagcatgttacccatttgctcagtgatatggaaatatgtcatttgtggattacacatgagaactattgcttcagtatctgggagcttgatggttccatacgtgagcttcaaggtcccctttgaggtagactagaggggatcttgggtggcttacctatgcctccttttctttgtctatttgggtggcaagaagtctgtatcttcctaagtaccaaggcaccaagtttgtcttacatgtgtcagtcatggacaatagagaggccaagagcagaagcaaacagtgactgtaaaggaaaagcactccaaagagagcaagccaactttggatgctagagagaaaatgtaagagatcatgggtttgttcaatgaaaaaattccatggccccaacacatgttagtgttcttcatggtcagacggtgggtgggtggttgtgggaggaggaggggaagagaaccttgaacatcctcttagaaactgacacttgtttactgtgcataaggagctcatctttggagtttttaatgtttggagcatggcccagacttctgcatttttaacacgggatttgaatggaagtggtttactgaccaggctttgagaaacactggattagaatcatatgtagttaatgcagctcatattgcttaactggaccctcctttctaagcagtcttttctttagctttgtggcttaaacaagattaggcatagatatttaaataaggctgcaactctcagttacctttgtaactggaagcatagtgcagtacatttggctactgtgattagctaaggagcatatgccaagtataaaactctagacccatgagtctcaactctgtctgcacattagagccctcttaggagctttaaaatatatggatgactgggctttacccagaatgactgaagggttggtcttaggtgttggtatttttttaaaagcttcccacgtgatttccagcgtgcaggtaagggtggagaactgctggccaattgttgccatgaaacaatgggacttcattgttgccacacgttcagatctttcaatataaataaagtttttatgtgaaatctcctgactgaatgctgacaaccaattcaaacttttcaaaatgtagggtaggtagacaaaacacatctgctcacaagatgcaatcagtgggcaacaagtttgtgacctctgatgcaggtactattttcaagaatttcagaagccactttctagttatactaattaacatttttttaaaccactatgtagtatcctttagttcagactttctttttttctcccttttttatttggtctgaattttcttttgtttagctagaacccctcttttgtgtaacacacttatatttaagttatttaaacatttttttttttttgagacagggtctcactctgtcacccaggctggagtgcagtggtgcagtcttggctcactgcaacctctgcctcccaggctcaagctatcctcccatctcagctcccccagtagctgggactacaggtgcgacactacgccctgctaattttttgtagaggcagggttgtccaggctggtcttgaactcctgagctcaagcgatccacctgcttcggcctcccaaagtgctgggattacaggtgtgagccatggcactgggcctgtttaaacattttctaatattgatcgtgcaggaagtgggcagagaatcaatatttcgctagtgttttggttgcagggaagaataaataaattttcatgggttgtaaattattagaggctcattttcttatttgctttgtaagatgccatttttcccctaaattttatcatgtgcttttgcttttaattttttctctgcatattcatattatggcaatcttttaaagatctctcttccctcagctaaagtgaggaaatagctgtgaattcatgagcagtaactgcttgttccagaattcgtgtatttttctgatgtgccagacagtggctgacatgcacaaatatcaaatgttaagaatcttatttgtgggaaggtttggtctggtaaacatgaagctgtactttctgaaataagggaatattaaatgttcgtggcagatggtgtgctcggaagtggacaattaggccaacagtaatggatgattgtaccctgagtagattaaagttatgtgctctatgtttgtatttgttcatctatttgtgtaatagtatatagtttatttggagggagagttaagtttaaggacttaaagacgtgtatcctaaaggctgagattttgtaatttatattggtttatttccttatcactgagggcaaatgtgttcatcacttaaggccatcaaataaagaaaagcaatagcaagtccaagataaatactgatttaagtgcgcaaagaccagtgtgtggttgtggatatcaaaatgtagccccatttttaatttcaataactagctttttaagcattgtttttgcattttctcctattgtctgttttgaaggaagacatggagccagctgcatgaagagtgtttcagaggaaggaaaagcaagtgcctagaagcttggcacatgagaggaactaacaggaggcagagtggctggagtttagtgctctagggaggggaggccgggacattggctcaggagaagtaggcacgggctagaatatgaaaggccatggcaaagaccgggttttacttaaagagccgtgggaagtcattaaaaacatttctttttaacttactgtattgaaataattttaaagttcgagaaaagttacaagaatagcaccaaagactcccatgtaccatttacccagatttatcagtgtttttgctctttgccatgtttgcattatcattatctctgtataattaataaaaaccatttgagagtagattggaaacattcaagagtgtgttttctaagaacaaggatattctcttatataaccagaatataaaattgaacattgatataatactttttataacatacagtccatattccagttttgtctgttgtctcaataatgtcctgccttttgccgccttactttttaatgtataggatctagtttaggatcacctgttgcctttggttgccatacctttttagccttttaacatctggaactgtttctcatcctttctttgtttttcatggtgttggcatttttgaattccatataaatgacgctgtgtccttctgaggttaatcacatctggaggtactggtgtccctcttgcccctcattggggattttaattttggctacacagtcgaggtagtgtgtggtttctgtactgaatagttatcatttttttgaactaataagcaatctgtggggaatacattttgagaccatgcaaatattctgctcctcattaagctcagcactcccaaccaattttcactgtgatgactacaaaatggtgattttcccaactccaccactccctttatgtttattagtggcaaaagagatagctatttggtttagaggtggaaatgactattaagctatcaatcaaggatattaaggagatatatcagattctgatttggacttattttctaagggaaatccaagttaaatttttttttacattagcagtatacttatactgctgataaatgtgctttctaaaattaaaaatagtatgtggctgagttaagtctgaaatattttaaatccctttttattgagatataatttatgtactataaaattcactcttaaagcgtacaagtcagtagattttattatagtcaggaagttatgtaaccataatcactgtctaattccagaatattttcatcaccccaaaaagaaacctcatacccgttatcagtcattccccaatactctctattcccagcccctggaaaacactactatttgtgtctttggatttgccttataagtggaacaatacagtgtggcttctttcacttagcataatgttttcaaggtttcattcatgttgtagcatgcatccatacttcattccttttaatccattccatagatataaaattttatttatcttggaattttttgatgctaagaccatttgcatttttagtgtttttttttttttgccttttatatatattttaaaggtaaactactttttgtaagttattgaaaatgaactgtagtctttagagtagtttagttattgtttttcatatctacatacatttcattattacatttactgtttcttaatgatgttgctcatcctctaactcttaaaaaaatcgacgatcagctattatcttatggttttattgtcaaagtgagcattttgcttttggggggttgattatttcattacttgaatatattacctgaagggatctcctgaggtataaatgtttggttttacttagcataatgtaagtatgacacctatacaatcaagctgccataagggattgaaaccagtggaatacattaatacaataattaattttatttttattttgctgaagttataacaacttacactcagggagccaccatttctggacagaacatatcatataactttttaaatttttttttggaaatggtctttatagtttttttgaaagcaggagttctaaggagactgagttgtagcaactacctaagatatacttaggtttaatttactggtatgtagccttttttgggagggtggtcaggaccttcttaagaattacataaaagttttggactttctcctattatagaaaatgtacacatgcatatatactaaaaattttacatatggtttcagagggcttgtagaaatcattatagaaaaatcagagaaagaagatgggaaaggatgtagtcagattcactcctgaaaaagcccaatggagttaaggataaagaggaaggtagggcagtaattgagaaaacatagctagtaatacttttcaagggccatctgtctctttgcagttccattctttctctctagctacatgttttgctcctgtttttatttcctcttttccttcttcttttccactcaggaaagtctttattcacaatttatgggtctaatcacctggggtttacacctaagatttataatcagacttttagaataagctgcacccatcatacagtcttccagttagcagtagccaccagaaaacactttatatgttcttctaattgtagatgtttaattgaaagattgggattataatttgctgctaaatgtctttaaggccacaaaaatgttgtagtttttgcctattatcctatttgtttgtctctaggtgttttttttcccccagtgatcatagcacacaacttaatgaaaggaaggttgtggatccctaagtacatttatgtttccccccaaccaattactttgtacttaaaatagttccagacttctgacattggcaggcaccattgcattaaaaccctggctctctaaaagggattctgggaaaggttcattgttgggggagaatcgttgtaataggaagtatattttcacagaaaggaatcttatgctgtctctgccttatagactcaaagaaaaggtgttgtgactcaaaaatgacaaaattaaagttgctttgctcgaagtctttctaggagcttatgtgggaaggataaagatgcatttgtcttaaaattgtgttgtaggatatatagaaattcacaattattgtttagtttttccttttgaattattatttcttctttatagtgatattcatggtggaatcttcataatttttcgttatgcatcttctaacttaaaatctgcagattaaaaaaatctctttttagcttctaaccagcagtttcaaataaaaattcagagcaggtagagaaatgcttttaaaatgcatatttgatgtagtaagtgctatgctatgcttctgaaagcaccagggtcacagctgcatacatgaaaatgcatggtgactgcaggcattgtttcctcacacagaaaaggcaatctgtgtctgtcgctgaatttatgatgtaaatcaaatcatagctttcctatattcagagatgtagcaagaaggttgaggtgacctaaaggttacaaataacttttgctttttgatttgcctatcacagactattttttttaaccccctcatttctattaggattgatgtgtttatacttggaaaggtgaatccagttacagattttatcattgcctctgtgctagtctgggggaaccatgcatttatcattcactccttcctcactccattctgttaggatgcatgtactgtactgctctgtgctgttgatgatattaataaagagtgggaacactgaaatattaggtaccaactctgtgtgcttcctctgcttttttcttctctgaacagtgttgactttgggacaatgtgctagagggactgtgttaaattggcttcccatgatcctgtttattctgtcatttgcaacaacatgaatcaaccagtttaagagtttaaaaaggtgatttggggaaagtgtgtatgtgataattacgtttattgtagataggcatttggcactgaaagggaaacaaaaagattaagaagacacatacccagctttcatgctgcttatgctataatttaataaacaaacctatcttgatgataatcataattgtacccacttatgtagttcttctatttgctagatattatattaaatgctttacttaaaatagcaattaaaatatttgcaaatcacgaaatggggaagtgccaaaggaggtacaacaaattggatcatctattgcagaaaaacaacaacaaaaaatgcacacagtgaaggagacattagaggcactagagaccaatgaagggtgacctgactgcctggtttgtattgatcttgatatttagaaataatacaattctctattaaggagaaagcagaatctattggctatctcaggagttaggaaattcagattaaaaaatttctgtgggctcttcctggacataacacttccttctgaaataaaaaaatatagggtgatttatctctgagctaaaaatagaagtccttttttttgaggacttagattttattagacattgggcttagagccatttaagcttggcatagaattattagtagctgagagctgccacctttaatactttttgcctttacagggtttgtttgcatctgtagtcctgagcagtcttaaggttagggttttaatgggtggcttgggttatacagtattcgctctggaaagtatttagtctgatcgccttattttattattggtgaagaaactttggccaagagaggttaattctcttgcttgagatcacttgatttgtggcagagccaggatgtaaatttggaacttttgattcttttaattcagttcttttccctcacaattttatctcacctctccacttccatttttttttttaattattgttatactttaagttttagggtacatatgcacaatgtgcaggttagttacatatgtatacctgtgccatgctggtgcgctgcacccactaactcgtcatctagcattaggtatatctcccagtgctatccctcccccctccccccaccccacaacagtccccagagtgtgatgttccccttcctgtgtccatgtgttctcattgttcaattcccacctatgagtgagaatatgcagtgtttggttttttgttcttgcaatagtttactgagaatgatgatttccaatttcatccatgtccctacagacatgaactcatcattttttatggctgcatagtattccatggtgtatatgtgccacattttcttaatccagtctatcattgttggacatttgggttggttccaagtctttgctattgtgaatagtgctgcaataaacatatgtgtgcctgtgtctttatagcagcatgatttatagtcctttgggtatatacccagtaatgggatgactgggtcaaatggtatttctagttctagatccctgaggaattgccacactgacttccacaatggttgaactagtttacagtcccaccaacagtgtaaaagtgttcctattactccacatcctctccagcacctgttgtttcctgactttttaatgattgccattctaactggtgtgagatggtatctcattgtggttttgatttgcatttctctaagggccagtgatggtgagcattttttcatgtgttttttggctgcataaatgttgtcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttccagtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgccaaagatcagatagttgtagatatgcggcgttatttctgagagctctgttctgttccattgatctatatctctgttttggtaccagtaccatgctgttttggttactgtagccttgtattatagtttgaagtcaggtggtgtgatgcctccagctttgttcttttggcttaggattgactcggcgatgcgggctctattttggttccatatgaactttaaagtagttttttccaattctgtgaagaaagtcattggtagcttgctggggatggcattgaatgtgtaaattaccttgggcagtatggccattttcacgatattgattcttcctacccatgagcatggaaagttcttccatttgtttgtatcctcttttatttccttgagcagtggtttgtagttctccttgaagaggtccttcacatcccttgtaagctggattcctaggtattttattctctttgaagcaattgggaatgggagttcactcatgatttggctctctgtttgtctgttgttggtgtataagaatgcttgtgatttttgtacattgattttgtatcctgagactttgctgaagttgcttatcagcttaaggagattttgggctgagtcaatggggttttctagatatacaatcatgttgtctgcaaacagggacaatttgacttcctcttttcctaactgaatactctttatttcctcctcctgcctaattgccctggccagaacttccaacactatgttgaataggagtggtgagagagggcatccctgtcttgtgccagttttcaaagggaatgcttccagtttttgcccattcagtatgatattggctatgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagcctttcatcccagggatgaagcccacttgatcatggtggataagctttttgatgtgctgctggattcggtttgccagtattttattgaggatttttgcatcaatgttcatcaaggatattggtctaaaattgtcttttttggttgtgtctctgcccggctttggtatcaggatgatgctggcctcataaaatgagttagggaggattccctcttttccacttctattttcttctgagatatggacatggctacataacagtaaatgattatgatagtgttctgtagccactgcatatattaatataaataataataacgatgataatgtgcagtgtttgtgtttattttttcaaaacttgtataggttattgtctgctactgttagatttatttacaagtgatcgggctgattcatcagcccatctatccttttgaataaagtgttgttaggcaacttagtattcataacttgaatagctggtttggggataattagaaatttgaggcatgactcaggttgtgttttggcgttctttgtaccacattcttcccttttttgatcagtaatgcttccaatttaaagttgttaacttgactcagttaaattgtggatcctttcatttaccttgacctttctcagttggatgtacttgaaaaaatggaaaggctaacaagcagtgggtgagaggaagaaagtaaagaaaaatcttgagtaatccataaatgtaataatcaactcttgaatacagcaagactgagcaatacttagccttatggaattttaaatgctttaattataattttttaagtaggaaaataacttcattttctatcatacccaaattagcatgaatattctttaatgccttttattctatgttttccaaaggaataattttacatttgttttccattttaagccttctagtttctagtgtgttctgttactcttgtgcatccagtttgataactatatttccataagaaaatcacaactctgatcttgatcgattaactacttttcattcagtgttaggaaaggtgaaactggaagcatagtgttttttttttttaacaatttgggactggtgcaatgctttcttcggtgatgtgccttccatagtgcttgtcatttactcaatggagtgattcttgaccaggagcaattttgtcctccaggggatatttggcaatgtctggagacaattttgattgtcatgactaggagaaatcctacttgtatctagtgggtggaggccagggatgctgccaagcattccattgtgcataggacaacccacacaataaagagttatgtggcccaaaatgtcagtagtggtaagactgagaaactctcatgcatgggcagttgtgcaatgaagtttattgaattaaaaaatacatccattatattacgtgagcctaaggctttatggattattttatatatgtattacacaccaatttgatgactcttaagggagaatttagctgtttgcttcattatgattaaagtattaaaattgtggcagttataattgattataggttagtatacttagttgaaatggtatgttagtaatcaaatgctgatcaacaggaagattcagtgttctcctcttatacttcccttttccctcaagcttttcagcttcttagaatcaatactgtgtatcatcacctgcaatattgccactcagttctgacataatcaattatttggaaaacttaattatccagatgtctaaatcagtaattaatctttatgatccctatcctactatattctacttaatctcattttttgaatttaggtctgagatactaaataaaatctgctgaatccaatagctagcaaaacaggccttcagcatcatgcaacaaagctggagtggctccctcggtatgcataaatgtaaattagaattgtttgccacatatacatcacttttaatctcattttatactattttttatttctgttgacctgattcaatttggacaaaactgagtattttaaaaaggagatagattcttagcggttttttttggtggggtgtgaaggatggaagggagatgacttataaaggaagaatattgaaaagcacttcggtgccttatgaccatacaaaaactgtgtgataacttgttgagttttctttttaaatatttataagtgccaccattatctggaagattaatggatgattatatctgatactctttatagcgatatggttcttatcagaagaacccaaagctgctgaaataattgtaggtgctatttctgctgtttcttcctttttatgtagtgagtgtttttttgtttgtttgtttgttcctttgtttttggtagagactgggtcctgctatgttgctcaggctgatgtcaaatccctggcctccagcaattctccagccttggcctcccaaagtgctgggattacaggtgtgaatcactgctactggcctgttttgtggttttaattgaacacgacctgctgaactttcaatctaagaatttcatctgatactacatacctgagaggcttttagaatttgtaatatttttcttagtatttgtggcaaccaaagtggaagcaaattctaggtaggtttaactgccaaagggtttggaattgggaaacatgaatgattttgatacgatttctgagttttggcataaaaagttgcttggagtgatcccttagcaatggtagcattcccgtcagtcagaaatagcctgtgctttagcaagcaggaggctgccagcatgtgaagttagttagtacatgataggttaggtgaggttaagaagaaatagatagtgttatacccacaaactgtgtggtagtgtcagagaggtgtttcacatgtgtttcaatgtgatagatctaatgtactcttctgtttttaaaagagaaaaaaaaatagtacatttcccacccccaacacccgtgcagtagtttttacttgtagcagttctgaatcctggtaacatattaaaattacctgtagaattttaaaaaattgctaggggacaaacttcattcctagcagtctaagataacagacctgggcattagtattaagggctctacagctaatctaacttgcaaccaagaataggaaccactgctttatagcagtgcatcagaatttcctgcagggctatttattaggtctgggctagggcttgagaatttgcatttctaacaagttcccagttgatcttactagtaaggcatcacattttgagaatcaccatgaaggcaatcttaaaaaatcatctgagtgtaactgatggtctgattgttactcttttttgaaaaatcattgctggagatatattaaaattaaagactagctccgtgtatgtggttccttttatgctaaaaagattgatatttctgtattgtttgcatgtttttacaatgagcattttaatgtttttttttgagatggagttttgctcttgttgcccaggctggagtgcaatagcataatatcagttcaccgcaacctccgcctcccaagtttaagtgattcaccttcctcagcctcctgagtagctgggattacaggcatgcgccaccattcccggctaattttgtatttttagtagagacagggtttctccatgttggtcaggctggtctcgaactcccaacctcaggtgatccacccatcttggcctcccaaagtgctgggattacaggcgtgagccaccgcgtccagccttaaatcttatttaaatattttcttggaggaaaaagccacataaataatagctaaaaattgtatagtacttaatagtttaaaaagctgaccaatttacaattattagtagagtagcctttttgaactatttaaaataactcatggttgtactttttgtttttttttggggttaaaccccattctttgagaatccttcaaatttcagattttatgttttatatagtctctttaggtatcttaatagaagtagctcaaataaacggattcatctgcattcaacagaaattttatgcatcttcagtttggatagttgttaagatggaaggaatatttccttttttctattcttaaatatgctggggaagcgcagaaccatacaatgggaataatgaagtacctggaaacagagagggagagacagagcttatgggttcgggtaaggttggaggaaatggaacttaccaggcttggaaagagagcagcggtagcaggaggaggaggtggcttgtaacctctaggaatgaaggatcaaggggatggatatgagagagctgctggattcaggagcttggccaaagtcacagaactgttaaatggaagagtccattcccagatttggatctctgaggctcctgtgtccattttgttttctgcaaaaatgttaggaaaaggcaggggggagagtcagttctgatgaaccaactctgcaacaaatggagcaagtgatcattttgtgacaattatgaatcgtgaaaaaagtctctagatggtaggtactggcttctttgctgctatatttggatattgaaaatgtgtagtcctgaataacaggttcccatgtgactttctgtgtctttcagaaatcatcctcatcctttgataactgtgcttgaacacagacctgattgctggccagtgtttttgcagcagctgacagcgtttttccagcagtgccctgaaaggtaatgtaaaataaaagtgtaaaataaagtgagggagacagaatggtatatgctaattttagagctagggtttttttttgtttgtttgtttctttttagctgctttgatctataatgttttctcctgaagaaccatcctagagcaggttgtagttttcttttctttttaaatttaattttattattattatactttaagttttagggtacatgtgcacaatgtgcaggtaggttacatatgtatacatgtgccatgctggtgtgctgcacccattaactcgtcatttagcattaggtatatctcctaatgctatccctcccccctcccccaaccccacaacagtccccagattgtgatgttccccttcctgtgtccatgtgttctcattgttcaattcccacctataagtgagactatgcggtgtttggttttttgttcttgtgatagtttactgagaatgatgatttccagttacattcatgtccctacaaaggacctgaactcatcattttttatggctgcatagtattccatggtgtatatgtgccaacatagtgttggaagttctggccagggcaattaggcaggagaaggaaataaagggtattcaattatgaaaagaggaagtcaaattgtccctgtttgcagatgacatgattgtatatctagaaaaccccactgactcagcccaaaatctccttaagctgataagcaacttcagcaaagtctcaggatacaaactcaatgtacaaaaatcacaagcattcttatacaccaataacagacaaacagagagccaaatcatgagtgaactcccattcacaattgcttcaaagagaataaaatacctaggaatccaacttacaagggatatgaaggacctcttcaaggagaactacaaaccactgctcaatgaaataaaagaggatacaaacaaatggaagaacattccatgctcatgggtaggaagaatcaatatcatgaaaatggccatactgcccaaggccattaaaaactactttaaagttcatatggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagatcaatggaacagaacagagccttcagaaataacgccgcatatctacaactatctgatctttgacaaacctgagaaaaacaagcaatggggaaaggattccctatttaataaatggtgctgggaaaactggctagccatacggagaaagctgaaactggatcccttccttacaccttatacaaaacttaattcaagatggattaaagacttacatgttagacctaaaaccataaaaaccgtagaagaaaacctaggcattaccattcaggacataggcatgggcaaggacttcatgtcaggttgtagttttctattttcttttaaagagtaaaagaaaaaaatctaccagatttattggttgttgaaatactgaatatgagaaaagctgttattaaggaagttaagcattggtaagtggttaggaaagttggctagaataattcagtaagctactacacaatacatataggagataagttcttccccttggacactggctaatgagttagtctctccattagaaaactgccatttgagataaagtattactgccaagtgggatcagatagccaccatatgtgcagttagtgtactttcaccaaggcctcctgatggctctcaaagctactcccctttcttctatccttactaccatgacgctggttcagggcctcaatatctcttgatgtggctcttgccacctgttcctaactggtgtctctgcctccagtcttgtcctggtcaaatccagtctctaaacatccctcagaaggatatatcaagagagcagatcttacagtatcattcccatgcttaagtctctgtggctgtggttttcaaactgcacttgcagtgcatgggctaagcatggagcatgttcccacccctttggctctgttttcatagcacttacttgttgatatcttatggaagctttctatgggaaaacaaaaaggattggtttctgaaacagtttgaaattccctggactataggataaaatctaatatgtcatagtaggcttagtatatgatgcagttccaatctatctcaccagctttatcttttcttatcttcatctcgcagtttatgctttagcagtacaatgacttgccttgtgttccacacaggaagcagtgctgtttccttctctccatgtttttacttactggtatctactgtactctcttgaatcttaccccactctctttctgataaatgtctttatttgaaatctctgtttaggcattttttttgccctagggtcttttcttactagaagctgtattaggtgtgtctcttgcatggttacataataccttacagttgcgacattatcataattactctcctgtattaactgtgaaatcttgagggcagggactgtgtttcattattctctgtattagtgatgcttggcacatttctaggtgctttataaatgttgaatttctttaaatgaggttgcagtgagcggagattgtaccactgcacttcagcctgggtgacaggttgttaatgagtatatgagtagcgattcacaactatgggaagaaagcaaaatgttgtaaggatagctagctatttatgttcattttaatattatgtatatgtcctaaaatgacaatatatcttcatgctagattttttgggggggggcgttacaattattattatttttaagagattgggagtctgctgtgttgcccaggctgaacatgaactcctgggctcaagtgatcctcctgtctcagccttctgagtagctgggactataggcatgcacctctgcacacagtatttgggtattattttataattaagttctgcattcatttattgaaggcctatgactttaacctttcaggaactgagaatttgagaatggtgcaaattgataatatcatggattttaggctgggttactttaagattatctagtctaacataatttttcagatgagagaaccgaggagagcaacattaaacgacttactgaaggtttcttggctagctagtggtggagttgggcctaaagcctccgttatttttatttttatttttttttgtggcagagtctcactctgttgcccaggctggagtgcagtggtgcaatctcggctcattgcaacctctgcctcacgggttcacgccattcttctgcctcagcctcctgggtagctgggactacaggtgcccgccaccatgcctggctaattttttgtatttttagtagagatgaggtttcactgtgttagctaggatggtctcaatatcctgacctcatgatccacccgcctcggactcctaaattgctgggattacaggtgtgagccaccgtgcctggcccaagcctccatttttttactctctctctaggtctgttttttttagtacttctccctctgtggtgaacttaaatataaaagacttgtgtgtaggtacatacataattggttacatttgaaaacattttaaatcactttgggatttcagattatctgtttttttaatattcattttttcctaagccctggtaatgtcttactccaccgaagtgatgattaatcatcagataccacatgcagaatctaaaatcagaacagattaagccaaggggatttttaaatagtatattgtccttaaggaagttcaacgtttgctcctgatgtcaaatcataatggcatcttggaaatgtatttctttatatgaaccttacatttcaccttcagcatctcaaagtagaagaaaaccgataagccatccatggatgctgttgacacccggatagtatttattctttggggaatacattattaaagagagatggagaaggaagtttcttaaatctcttttctgggaactttcactttgtatttcatacatacattatctgattccttcatctatctttttttagtttccgaaagtagaaggtgtgataaagatatatgtttcagtaataattttgaagtgaaaagtccttttgatttttatagattgtataagtatttgagcttatgataaaaaaatttcttcagactgtgagctctatgagagcaggaacttaatctatttttatttcttgttttgtttccatcatgtagatgagtgaggtatactgtaggtgatcagtaaattttaccaagtgaataaattaatgaatgaataaaatttaattggcttggtaacttttacatttttattaatcttaatggcattttgaaatcacattgctatgaaatgtatggtattgtaagactatgttgtcaagtgttatttattttattataattaaaaagaattcccttttattttagattcaggggtgtatgtgcagatctgttggaagggtatattgtgtagtgctgaggtttggccttttattgattctgtcaccccgtagtgaacaaagtgcctaacaggaaaattttcagcccttgcccctccttcccaccctctgtttggagtcccttgtgtctgttgttcccaccttcatgtctgtgtgaacccaaggtttagctcccactcttaaatgagaacggtcaagcataatttaaataccgtttcttccgtgaagcaattgcactttatacctttcttttggcagttgtcactttctatcatctagttcaggatcataactgattgtctctgtcagactgtatgcttcttgaggatagataattcttatttcatctttgtatcttatctaatcattccttatatataagaatgtgaaaaacattagaaaataaagtcatgacatttaattgcatgctcattataaaactactctgtaacttagtgtaactgaattaattaaatgattgagcatctctttgaaggcctagtatgtacagttattggtgataatagcagtaaacagaaatccgtggcctcatttggtttatagtctggcagggggatacagatattaagtatgtaataataacagcttgtaatctcagctacttgggagactgaggcaggaggattgcttgagcctagaaattcaaggctgaagtgcactattattgtgcctgtgaatagccattgcactctagcctgggcaatgtagcaagacactgtctcttaaaaaaatgtaatggcaataaaggcattgtatcttaaaagcacatctgatgtgatctgatcaaggtgaagtgtcaaggaaggacctgagaaagtcattttaaagcagataactgaaggatgatagaagctaggtagggagaaggaataggacgggtagaaggggagaatattacaggtagagggaatagcaagtgagaagaaagcccagatggcttgataaagacctgaaaggagtttagtgtggtttagtggtgaatgaagagcaagaaatgaagctggaaagataaacagaggccaaatgatggagggtgtgtgtgaattgggctagatactgtttaggctagttaatgacatgaccatatttttatttttgatgatcattccggtgttttagtgaatttggactaggagttttcaggatatagtgaaatctaaatagatacaaaagatttgtagggtgggaagtgcttaagaagaccttgacaaattatttcacctctctctccttcagtttctttatccgtgttataaggataatattattttttatttcatagggttgtggtgaggattaaatggatttaaagacataacatgcagtaacttgaacactgtaagggttaacaggttaacaagtaaatgttaactgtcatcataatcatcttgggatgtttgtctggatttcttttatgtagatcctcacctgtagagtttttccaaaaattcatgtttgtgtcatactcctggagaggtgatcctgacatctgtaattctagaaaggttgtcaggtgatccttttttttaagatggagtctcgctctgttgccaggctggagtgcagtggagcaatcttggctcactgcaacctctgcctcctgggttcaggcgattctcctgcctcagcctcctgagtagctgggactacaggtgcatgccaccacgcccagctaatttttgtatttttagtagagacagtgtttcaccatgttggccaggatggtctctatctcctgacctcatgatctgcctgcctcggcctcccaaagtgctgggatttttataggcgtgagcctccgtgcccagcccagatgattcttgtgttcactaaacactgatttcagagatgtagttgctattctaatgtgcaaatagagactgtcttcatcctgggcatctagcttacagtctccaggtgttgaataattttcctcagtgtacaaagaactgtttggcatagatgtaggcaggtcatagcggaatagaagaatcataaaaagaagttacacttgatgatatggtagattatgttatgtcatgaactataagttgatatttgccacttacctgcttgatagtgtgtttaactcaataactggctaatgtatttcatgtcttataggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaggtctttgtcctcctccacaaatataggtcagcatcagtaagtgttgttattgtcatagacaaagtagttctagaacataagtgatttggcaaactcagacatgatcctcgctctagaaatgcttacaatcttttggggaagatgaaagaaacaaaatctagatttaatatgaatatattatattcgatattaactaaatacacagaaattataaatcgacatagtccattctgggaatagcaagcatgaaaactttcctttgtttaagaaacagttatcaggtaaaagattttgagttgagtttcttctgtgtagacattgggacagtaacaaggaaaaaaaagacctctgtgcacattggaaaaaaaaaaaagatgtgtctcagagcataaatagctctgaggatgcaaagcctggccagctgagtgccagctagattccagcttccacatgtccccttgcaacatatgcagcagctctcagggatcctgctcttgagaagcacacatgtagtaaatgagttaggacaagtactgtacatatattcttacaattcaaagtagaaagatgaaaggtggttaacagaggtatggataaaacacggacacagttcaggggaaagagaaatttgagtcattgtctctataactgcatatgaaaaaaaatccagttgcccaggtgttgtgattttagtgtagtgattcatttatcagtccatctcttcccatcatctaggtttgctatttgcctggaatcgcagcaccatgctgcttagctgatggagggaatctgtgaacatatttcaaaacgatcacttgaggtcacacatgacctgctttaagtttgtgttagcagggagtgacttgagtaaatctttcctctgcgacttataaataggctttcctgtaatcaaggcagagaaaatttaattaaaatgaattctcctgtggcttttccaaagcttttgttttgtgtgggcaataaagcaatgtataggcagaacatcttgaactagggtacatttttcacgtcatggctgcattaccctgttctgtgctccttggcaaaggtttgtcttcatcttatgaacctgtgttgacaggcttaaatgcttttagaaatgagctcggtggaatatttctgggaatctgtggctttttaacctaacagttatgtaagaaaaaaggggatacatcatttggaagtactggaactagtgacagtagcatacttaatcaatttaacaaatcagctttattagaatgaagcgtgtgagggttggacgtggtcttagagacaatataatccatttaccactcaatacagatgtttcttatactctctgaaacatgactatctcatggctaattgaatattttagtgatagaggaagcgtactattttgcaaggcaaccattttttttagcaagtactttttgaccttcatttttctcattcattcatttccattcttctcagaacaaaatgaaataagcttttaaaaaaaccccatctgtatcctatcttatttttctcccttctttccttcccgtttttccttccttcctttcctcctcacctccctcccttccttatttttttcttcactttcttaatctctccattgcaaatggtttcccaacttttctctgttttgttttgccaggaattttctagtttattgttgctcaaaatatgctactatgaaatgatcatcttagagatgactacaatgctgttgatgtggtcttttttttttattatactttaagttttagggtacatgtgcacattgtgcaggttagttacatatgtatacatgtgccatgctggtgcactgcacccactaactcgtcatctagcattaggtatatctcccaatgctatccctcccctctcccccaccccaccacagtccccagaatgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatttttggacatttgggttggttccaagtctttgctattgtgaataatgccgcaataaacatacgtgtgcatgtgtctttatagcagcaagatttatagtcctttgggtatatacccagtaatgggatagctgggtcaaatggtatttctagttctagatccctgaggaattgccacactgacttccacaatggttgaactagtttacagtcccaccaacagtgtaaaagtgttcctatttctccacgtcctctccagcacctgttgtttcctgactttttaatgatcgccattctaactggtgtgagatggtatctcattgtggttttgatttgcatttctctgatggccagtgataatgaggattttttcatgtgttttttggctgcataaatgtcttcttttgagaagtgtctgttcatgtccttcgcccactttttgatggggttgtttgtttttttcttgtgaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgctgttggtgttttggacatgaagtccttgcccatgcctatgtcctgaatggtgatgcctaggttttcttctagggtttttatggttttatgtctaatgtttaagtctttaatccatcttgaattgatttttgtataaggtgtaaggaagggatccagttacagctttctccatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagtttttttccaattctgtgaagaaagtcattggtagcttgctggggatggcattgaatgtgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgatgtggtcttacttatactgagcactaagacagaatcacatttaaattttaaaatacaagctttagaaataaccatgcaaccttgttgaccaatcatgaaagaatggtcagtgaaactcctttttctgtttcttctccttccagttgctctttcattttatagatgtagaatagtccttttcattttaattgcgactcttgtcacctcacatattacctattatattattaaataatatatttctacataaagacagaatgttacttcaaaattatgcttgtttagaactttgataatgttaaagattagagagcctttaatgctaggttgctgagattgtcttttgaacctttttttgttatggaaaattagaaatgtacacataaatgcactcaaggaaatatattgtcaagtaaacattaggctttattttaaatccgtctcttctctgtggccttttgactttcctactgtgtgtttgcaagagagcaaaataatttataccagactgtttattttttataacaatgttttctgctatttcttctctttgatcttttaatatcttttttctcttgtttgctagcaactaatttttctctctgtgtataactaatagtcatttgggttattatggtgataaccactggtaaaaggtactgccggtcaaccgtaggctttcttcttgatgaatttagcagacataggctcctgattgaagcagatggtccgttgtttgtaatctctgggaaatgccaatgtgtctgtgagcaggaccatatccttaataccaactccagaattttgatcagaacagctgggtttgaattgcattgggattttcaagagcacccaggtccttcctatctaatacattagcctgttgagaagacactctaccatttgaatatggtcttttactatatctgccaagtgtggagatgatactctcagttaaggctgcctgagcaagtatcttgcagataaagggcttagtaccgtgttagaataacatgctgactctttactatcaggtatctatgttggaattgtagaaatgagagttcatttggagaattcaaaactaaacttaatttccctcaacatgttgtcattgtcatgtaacttgttttaagacatctgcactcagacaagctagaaaaatgaaagaaaagaaatttgtaccagccagcagtaacaaaaacagtagcaaattggattttggttaataaccagaggataaggtgcagttgtatagttaatccttcatggagttctgtaactttttttcatctcctttaagtctttataggtttagagaaaaaattacattgttcaaagctttttgtgtactttaaaattatcttttggtttgtgtattttttaatatcatataatgacttttttaaacaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggtaaggatagtagtatattatactgttcatgcattgctattaagaaatacctgagacttggtaatttataaagaaatgaggtttaattggcttacagtctggcaggctgtacaggatgcatggtgctggcatctgcttagcttctggggaggcctcaggaaacttacaatcatggtggaaggtgaagcaggagccagcacttcacatggctggtgtaggagtgagagagaggagtggcgagatactacacgcttttaaacaaccagatctcaatcactatcacaagaacagcaccaggaggattgtgctaaaccattcatgaggaacacctttgtgatccagtcatctgcaccagaccccacttctaacattggggattacaatttgacatgagatttgggcaggggcatagatccaaaccatatcagatagacgttttattgtgtcagttatcactcaagtgagtctttcaataactgggtggatctgctcatttagtttgcatattagaggcattttgatctaataccattagcgcatattgctattgcactactggtaatatcatttattagaaaaagaaatcattaaaatactcttcggatcatcaattaaagatcaccactgtgacttttttttcatttattcatgcagaacatatagtaatatgccaggctttatagaatacatagatgaaaaggtaaattctatgacctcaagagacttacagacatgcaaataactaaattatagtacaataagagaaaggattttatgggagtatatttaaaatgtaatgggagaacaagtttcaggaggtagggcatgagttgagattcgaagactgaatggaatgtgcctggtacaagggcctgggaagggcattccagctgtagaacagcatgtgcccaaatagagagacatgaaagagtagtcaggcttggcttattcaaaaaaacaagaggatgttgggtattgttgaaggattaagctgtggcaaatagggctgggcttgtcttccatgccacacaaatgagtttacattttatcctctaggcaatgacatgctgtttgagacctttcagcagatctcattttttaatgtgtggaagatctttctcgtaggaagatggaggagggtttgggaccgcacaccactaatagggtaggaagtgaggaggatgtcttaggcaggctaccacagactgggtggcttaaccaacaaaaatgtatttattggttgggtgcagtggctctcacctgtaatcccagcactttgggaggccgaggcaggcagattatgtgaggccaggagttcgagagcagcctgaccaacatggtgaaacttcgcctctactaaaaatacaaaaaattagctgggtgtggtgttgcatgcctgtaatctactcatgatgctgaggcaggagaattgtttgaaccctggaggcagaggttgcagtgagccgagattgtgccactgcactccagcctgggcgacacagcaggactttgtctcaaaatacataaataaacaaataaaattatttctcaaagttctgaaggctggagagtccaagcacagggtgctggctgattctgttcttgatgaggactcttaatggcttgcagctggctttcctcgcatgatagggagagtatgagctctgtggtgtcttatgaggatactatccagattggattatggccccaccctgatgacctcacttaaccttaatgacttccttactccaaatacagtcacttgagggttagggctttaacaaatacattttgagaggacacagttcagcccatagtgagggcctaatgagggaaatggaagtgggaaaagggagacatagaagacagaatcagtagggctttatgattgattagatggtcaaggagaagggtccttgatagaatctcagctttctattttgggctactggatgatgccattcactttgagaaatggtagctgatgttggagggaagatgattaattagatttcagatatgcttgacttgaggtatgtatggatcatacatcgttggatatatggttttgaaatttaggctagaagtctaggctaaaggtgtacatttgtagacattaactttggggtggggattttaaacacgggactgggtgacagggcttgtggtggaactctggggtgtttgtggtggttatttggaatttactgataaagaggaatctgagaaaatatgtctagaaggatcatatataaccagcagagacagatgacaagaaaatcaagggaaggaatatctcaataagagggagtggtcagcagtgtcatgtgtcatggagcgatgatgtaaaagtaagggatggaaagtattcttaggatatagcatataaaagcttattgttaacattagaggggcagtttcagcagggtggtggtggttggggggcgtggaaattggaattaagggagtgtgaatggcaggtgaggaaatgagagagtaaatgtagattttgatggaagttgggagcccaggaagactcaagtattacaagtcatttgtcaatttgccaatcttatgattagaatgattttatatatactgggactctaaataacatgttttctattatacagttacatatgtatcttatgtgtagtagatatatatatgtataatatatcaggtataattatattttacagatataatcatgttatatataatatagatagtatataaatgcatatatagatgttttatagataaatattatacagaaagatattttatagatcagtattatgtagataaattgccagttctgttaactgtaaatgtaatatccatgggtaaaacccatatttttcctgggtacttttagtagattcatgtgagtagcaagtataatttcatacagtttagtcctttttagtataattctctgaccattttattgtgtatttccccccacctttagcatatatttattaagcagatgcctatggcaaacactttgctatggcaattagttgaaagcagacaaggttcatgaagcttatgttttagtcaaatggttcaaactagtgtgcataaaaatcactaggcagagtttgttacaaatgcacatgcctgggccttatccctaatgatattgaattagcaggtctgagtgcggcccaagtattctctattttaaagtagcacccacaggtgatttttatcatttattttgcacataaggcaaatagcacatagatcaaaacatagaactttgaaaccatcacacagctcaagaaatagaggtttctagccaccacagaagttctccacaagcccagtcctattcataacctcctttttcccctgactattcagacttctatagtaactacttccttacatttctttatagttttgtcatctcagtgtgtatctctaatcactgtaatatgttttggggtatgtgtgtgtgtgtgatcttttaagtgtctttccaattaaaggtcatcccctttcgtttcctcccccacttttcttccctgcagtttgtgtgctgaataacctggcttgtgtgagctggagagtttcctatcttctggattttgctgattgcaaccgtatggtgccctttaatacagtggtccccaatgcctgggccacagactggtattggttccttgcttgttaggaactgggccacacacaggaggtgagcagcccagtgagccagcattactgcctaaactccatctcctgtcagatcagccgatgcattagattctcacaggagcatgaaccctattgtgaactgtgcatgcgagggatctaggttgtgtgctccttataagaatctaaataatgcctgatgatctgaggtggtacagtttcatcccgaaaccattccctgccccaggtgtgtggaaaaattatcttccatgaaaccagcccctggtgcaaaaaaggctggggaccactgctttatgtgtttctctgttcaaaggtagttagctctaaaggcttgactgggttcaggatattttgttttttgtttccaagactacaggggatggtgtgttctgtcatcaagaggcacaatgtgtgttgcttttctttttatgatgttagtagttgttggtacgcaatgcctagttctattaattcattaggagttgcagagtggtaatgttctaatcctatcattccttctccatttattagctggaatacttccacaaaaagaatacccttcctccaataacctactagttggttatccagtggtaaaggaaagttagaataaatgctgtactcttttgcctttttctttatttactaactttaaaaaatattatgaattcatgaatttaaacatatttgatgcacttcagtctatcacagatattatccatattgaattttaaattgtcttattttggccactgggaatctattaataagtggctcttgaatctaatttttaaaatgtttttgattataatgtagagtcacaggatactaatgtcatttagaagaatgaaaagatttttggtgagggaaggtcctatttatgtctctcatttgcccaatgttttagcagttttagaaggaaataacaattagtagaactgttgaaatatttgtgtaatgaagttttctgtcccccatccccatcttagtgttcctgaggttaaaaaagtaagcctaggaaaattaatttgtgaacatatgctataggtctatatgtactacaatttgaaataaaatgaagtagaatgaagtagtcttatgtattttgacaccatacccacatttctgtatcgctgggtttatcagctggatgtcttgttcaaatattatattcactttttcctactctgttctctttctactcttatatcagcgttgtatcattgtacattgaaaatggatttatttcttaggctgcattagtttttgtggattcggtcttagttgagccatttttagcctgattagaataatcataacttaaggtcctttccatttcaagcaaaacagatgtaccctgaccagcaaaattaggcaaaaatgatgctcactgggaggagattgggtagctctcgaagtgaagaatgagtgaaacatttcagcattgggaagggtcggaaacttcccagcagcactactggctgatgactcagttccaaccaactttcttcactgtgtgtctcattttaagttttcagattttgtaggaaaaatgatctgtttggcccatcttggcttgatcaagctctggccaggggaacagagtacgtagcaaagttagagcactggaggattgtgtgggttgggccaccatctttgttttgtctgctaccttctcatgccttgttttctctttaaaaatacttttccatgactatactgtaaaatccttgagaaaagggactattttgtccacagtggcattcgtagacccagcatatgtccttagtgcctggtgcataggtgatgtttagtgctattttcatttgacttgaggacaaaaagtatggactccaggttgttttctgttactgggactcctccgacatctgtggctgagtataaaggcatttactcattttttgtattttatttcattttttaaaatttccttattttatatattttatttccttatttattttattgtattttatttatttattttattttcaggctctgagttagcctgagtttccctaaaggcaaaagtagagcctgggtttccacagaagcaaaggcttatatgactagagttcatctgacaatgtgatcccagcaagcagttggagagggacaaaaggagtgaagtatggaaggtgggagaggcaatacaggcatcatcaagtaggctactgctactagttgcttgatcccacagaatcttctgagaagccttatgaaagaaggatctggaattaatgggaaagcatttatctatggggtattgttgccgatttgtcagctttggcctatggggctttaacttccttgtacttctagagtgcgctattctggggcagggagcaagaggtgcatggtggagcttcaggggagaaccattaggttgcacctgtgcagagccagttaccacagcagtagctgtagcatttgaagtgtgcaaaggggatgtctgacacagggttttattaaaagatcttattaaatggtactatcctttggtgtccattaaaaatcaatcaatcaaaaaacttgtaaccactagacttgtaagcagtttaagatttatgtggtctaatcctccaccatttacttttccttatttttgatcttgaatctccacctcttttccattcaccctctattctgaacaggccagtctcacccttcctggagaaggccattttcatttttgccttcatacttttaagttccatccacttaaaaatacttctgttccatttcagaactctaaaaagctactttatgggccttgcagtaatagcttgtgtgaaaaaggctttccaataatagcattactatacagcagtgcttttctttgttgttgatcgttttggaatctagtaaatctgaggtttaagtgatcttgttggttttccttttgtttttttatggacatgcagaaattaaaatgaaatagaggaaggtatagcaaagaatggtatgatagtatatactgtaagtgtgttggtttcaaaatgcatgtattatcctcaaatagataagagttgcttcattgttttcgactgtatttcaaaacaatgaacacatatattcctaaaatacatagattggaatatatcccatttttaaaaattcacgaatttttttcttttgttgttttttttcaaaagtccataaacaagcacatgagaggattttgtaggttaatttcactcttcaaatggtaaaactgagattttagagggtatttgttagtttgatagtatcttcaagattataatttctgggtatgtcaaattatattgttttcactcaggcaggtggtcctttaacatgtggctctaacttacagatttcctttttttcctgtgggttttttttttttttttttttgactgtctttattgttcataggtacttctgctctgcaggcacttctgtaaacttcagaatagtcattttagctgaacctttcttctttagtgccataatacattaagattttctttatttagaaacctcaaataacatgtctcttgtgttttattaatatttattaaaacctaatatacacatctttttttcattttgtttatatacttggtgaacttaatggttttccatttctatggtcattgctctgctacatttaaatatgcttaatgaattacggtaattcgaaaataatctctacctccctggcactaatatttcttttattgtgacatgatttactaaaatttgtttagtgtaattcattatgcaagttatatagatgaatcatgtctgtattaggtaagcagaaaattgaactacttttcagaaatgaaatattattaaatttagtattttaggcaactttcaatggtttttaaagattgactgtttaggccgggctcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgtgccacagcactcccgcctgggcgacagaacgagactccgtctcaaaaaaaaaaaaaaaaaaaaaaaagattgactgtttagaagacttgctgatctgctgtgttgagttttcctctgaattatttggtttatagcatcttgctttttggccatataatacatcattttgaatttatgtgtgactgtgtggcattgactaattctttctttttttttgagatggaatctcgctctgccacccaggctggagtgcagtggcaccatcttggctcactgcaacctccacctcctgggtcaagcaattgcctcctgagtagctgggaaattagcctggctaatttttttgtatttttttgatagagacggggtttcaccaagttggctgggctggtctcgaacttctgacctcgtgatccacctgccttggcctcccaaagtgttggcgttacaggcgtgagctgccacgcccggccgaccaattctttctttagtagagcacacttgctgtataaataaatttgtgtaataggcttgcagtctttcatattaaatatattcttcctggatacatgttacaaagccatgattctgggaacttctttaacaactcctttttccccctctattcttttaggattttcctgttgaactggtcataattggaatagctttactacttctacagactccagcaagtcagcagaagccaatcttaaatctaggtaaataaaaatacagtcactagagtaaaatgtaaatataacatgagtattgacaggattcacttgaactatgtatcctgctatcttgtgtattttgagtttccatctgtaatttttaaaattattaaatagaattttttttcttgtctaataagttgttaccttgtgcaagttttaatataacataatttaccaagtatctcggctgcatgttagaggttataatctaaccttatatggcagtaacattcaggaatatattgaatggcatagcaccttattcaacattgtacagcaaaatggaaagctttagtataaaatccttgaaagaaaagtgtttagtagttgtagttatttttaaaactctccataccttaactattcaaaatgtaaatctagctagaacaaatgaaagataatattcttttgacagtccagtattgacttaaagaaaagtgaaggagggggccaagggtggcaaaaatgttctagttaagaagaatgtggtaaagaagctagttgccctatcgggcaaataagtcatacttttaaaatgtggcttttacattggtgctgcctcactttacttggtctgatccaaaataatccacataacaatgagagctctaaattatgttgtatagtgccatgatatgttgatatgctgctgttcttagttttaaaaagtacgtgagaggccaggcacggtggctcatgcttgtaatcccaacgctttgggaggccgaagtgggtggaccacctgaggtcaggagttcgagaccaagcctgggtaatatggtgaaaccctgtttctactaaaaatacaaaaaaattagccaggcgtggtggcgcatgcctgtaatcctagctacttggttggctgaggcaggataatcacctgaaccccggaggcagaggttgtagtgagccgagatcgcgccattgcactccagcttgggcaacaagagcgaaactccgtctcaaaaaaaaaaaaaagtgtgcgagataaatacttattgtatagctcattcttctgggcattttaattcatgattttgggagtgaattgctctttcacctacagtgtgccttggaaatggctttagcacatggaggggatccttggctcctaggctttgattcctaccctgcatttggctactggctttatgttcgcttataccttccctccacagtctgatccggtttttgcctttttcttatagcagtgcacatgggatctacccaaaggtataatttacccgtgctggtacttctgacagcaatagttttcttttttaaaacagctttattgaggtgtaatttacataccataaaattcagaataaagtgttttctagtaaatttatagatttgtgcaaccagcaccactgtctatcatctgcccaaaatttcttgtgatcatttgtagttaatcctcattttcaccctcagctccagagaaatactaatctgctttttgtctctgtagatttgccttttctagacatttcatatgattggattttgttttctgacaaaaaaattctaaagcctcagaaaatccacatttcaaattctgaagctatgttcttatattgtggttcatgtgtaagagaaagataatacagtatcaaacagtcaaatacttttattatttcctggttagcagactttttctttctctcgtaaaccaatatctctgatttgaagttaccttagagtgaataaactgtactgaacactgctaagccaatatatcatgttggaaagtaaggaagaactgtggggaaagagtattcaaagaaataggataaccaagagaatattgattattccaaatttaaaagatttatttatacattaatttttatattaatgtaatattacactatgtagttgttaactgtagccttgattacaaatagcaatttataaaaatgcctggaatatttagatttataatttaggctattaaaatactgctattatattcatttcctgttatattaaagataatggattttcataatatctcagaaacaattatggattaagaccaatatttaggcaagaaaagtaaattagtagtgttagagtaacaggtgtttgtacttaatatcatgttaaggtttgacctccagatgatgtaaaatagaatgctgacaactcattgacatgattcaaggcttgtagaatttttgctgtagtggggaaatcagttgaatattttgataatttaacgttgaatcccctgaataacatcttttagtaaatcagggttaattacatcactttgaaaaaaatattgtgaaaaaagtatatttatgccttaactcattcagttaatagtctagagactctacatgtaaatcagttattgtataactgtatgtatctggtgtgtaagttgtttccatgttaaagaaccattcactaattttttttgttgttgttattttggttctggactttgggactttcacaatctgcttcttagcaattacagctgaagggcagtcctgcttcactttgctgtttacttaagcatctgctaataggattcttagctgcctttgtaaaggaagcatgtatgttgggcttgttagccactgatccaggaattcttggtctcttagctctgtttgctgagggcaatactagcatctcagaggatattaagggcaaatgttgaattgtattttttaaaaaattcatattaacctaaaagagtatcatcaatttttcagttatatatgttaacagcttattttatataatagtttatttatactccttttatttccttttaggataagatttatcaacctagttatgtgtctgacccagttataaaagggaagaaaactttcttgcatatcattcttaagcaaaattgcattttgtttgactgtggtattaatttttaaaaatgtgcattattgttttgatgaatagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaaggtaatgaatctatccttgtttctcttaaataaagtgtcgatgtgggatttcggtctttacggataatcttgcctcctgatgaagcatctgtttgttatcagacttcaccattcagtcaggtagtgctgttggagatctcaacatattcttctggactataagaagggatagtagtcctgttgtgaaataagtttgaaaatgctatatgatcttttttttctctgaaaatccagtgcacaatactagttaaagatcctgaagagttcttcagaaaaggaactaatgcttctcaaatatatttgaacatggaatcattttttaaaattatactgttagttaagtacagcatattgctagatctgagataatccaaggtgggaaatagtcctcaaatgcctggaagttctcatatcagtaagaactaaaacttctttatttaatatggcacctcttgccgtgttccctggcataatggctctcgatgtcccctgtgtatgcccctattctgctgcctccaactggaagacaacaggcctgccacattccgtttccaatcctgcctgcctcattccgctttttcagtcttgcttttcctgttacaataacgtgaaagtgttgtcatggtttggatattggttgggttctaggcctagatttaccagactttttttgttttgatatttgagttttgcctttatcaaaatgaaacattatttcccagctcctcttatggggatgaaatgaggattgaataagataaagctggtgaagcatcttaaatctccatgaagagaggcactatgtaaatacaaactggagtgatggttgtggcttcatctgcaaaagcagagatacctcttatgttaaatgctccagcagcacaaatccagtcattattagttcttgtttgagcatgtagcagaaactggcccataattataggcaaattgaatgtatactacagcttcctaaatcctaattgtttgactaaaactttaaaacttgaaacaggtaatcgatttgaattgagagagaagttcttgcatcagccctaataggagtacaaaatccgatcaaaaaattctagtagcttttttactttacctcttggtttgcccatgtagaacaatgattggatcttgaatgggagtgggggcagggcaagagttggcagggcaagagttctgctcctttaaatcacaagtgttatttactgaggatcaccccaactctaatacataagtacttggtttactatttgctcagatgtgtgtgaatcttattattaacactaatatctggactttctctttagcagctggtaaagaggaggggcagaattactattagggctgtaaatatcctccttatgatactgtgttgctttaaggaggctttgagtagatatatgatcactgttttaaaaaatgtaagccacattttactgttggcttttttttttcctgcacctatctggaactttacattccagtcacacctatgaatttaacatgccccaaactcttcaagtctcttcctgaatctttgcttctgcacagaatgctgttttatgtcagctgcctgaactattcatccttcaagactcagccaaatgttctcagcctccctgagtcaagattatttgactattggatttttttttttttttgagacggagtctcactctgccacctaggctggagtgcagcggtgtgatcttggctattaaatgtgatatttaaaactacctatttcattctccccaggcaaaataaataaataaatattaaaaaaagtaaaaaaaattgaacactaattgtaaattctaaagggcttgaaacattctgcttcctccttgttctcctccactcccgcaagagaatgtgggggataaaagagagaatgcattcagtatatgagtcagattccagtcaggaaagagaaaacacactggcaatttgaacaaggaaaacttaatgcaatgaattattagcaagaggtgtttagttataaaaccttataaaaaagcatctaaggaatattacagtagtaaatgtagggagcagctactacctctaagctaagaccaaggcagagttcccaaggaaggaactaaaaagtctccccagacaatgctgagagtcagacctggtaggagagaatgtggagaaggcctactggatgatatagtctgctggggtgccataggctagaactggtccacaggaaaccacttgtcgtgtgagcaggctggaattggctgagctggtccactggaagccacctctgggatatcctgtatgtccctagcagccatggtaggaggaatcaaagaagcacacaggaacctgaagagaagccccttcttcctttccttgcagtgtctctcctatgctctctattgacaaggtctaacactagaccagagggcaaaggagaaatgttgaaaaggcacagctgtaggatcacatagtcaggcaaagaagagtgggtgtggagctgagaggtaacacattgagtaactggctcaggaagtaagaaagaatcggaaaagtttttttggaggggagtaagggtggatgggtgagatgaagtggaaaaggagacttaaaagctaaattcttgtaattgtacaggagggcaaaattcatctttatgaaactgttttagtcagcataacaatttagagacagcttgactgagctggggtctaccatgtgtttattcattcttatgtgtttttaaaaattaaatatggtacttttgggtctttggtaataaagctgtgccaagtagattttatttgaaattgctttgaagtagtatatagtaagcagaatatttgtttcttaaaaatcagaaaattcgcaaggaattgtcattgtcctacttatggctaaagttaacatttattgaacatgtgtgatatgccaggagttattatgtgggccaactcgtatttcttacaataactatgaaatagatgtcttttctttctttctttttttttttaatctatttccagctgtgtggccttggactagtgactgaatctgtgtggtatctgggccctggtaaaatgggcaacaaaacacccccttcatggggtggtttattgagcatttcatatgtgcaggcttcattttaagtactttggtatatattaactggtttgattttatctcacactctttgaagtaggtaaaattattgatctcattttacctaagagttaactgaggcataaagaaggtaaataacttactgtcatgcagtgggaacccaattcttttttaatagctttattgaaatgtaattcacatgcgcccttccctcatttaaagcatgcaattcagtggcttttagtatattcgcagcattgtatattcattaccacaatccactttagaacatttttatttttattaccctaaacaatccctgcactcttagtcatcactccctaattccccccttttttcctcacccctcaggctaggcagtccctaatctgcttgtagtctctatatggatttgcctattctagacatttccttcaagtataatcatacaatatgtggtcctttgtgactggcttttttcacttagtataatgttttcaaggtttgtccatgttgtagcatgtgccatgtagcagtgcctcattttctcttagagctgactaatattccattgtatggataccttacattttactttccttttcttttgttgacgaacttttggctctttcccactttttggctataatgctgctataatcattcatgtatcagtttttgtgtggacaaatgttttcatttctcttgagtagataccgaggagtacaactgctaggtaaggtgataactctatgtttcacagtttgggggaatggccagattgttttccaaaggggctgcactattctatattcccaccagcagtgtatgagggttccagtttctccctgtcctcgacaattgttgttattgtttatctttttgatggttacatcctagtaggtgtgaagtggtatttcattgtggttttgttttgcatttccctgatggtattcttaaaatacttattttacaagccgggaaactgagattagagcggttaacttttctggattacccaggtagtgaagggtagagttggaattcagattttgactgtttgattctagggcctgaatcctgttacctgcactttcattttgttttctttctttgtttttttggcacaatattttatcatctttgtgctgaacttgggcgtaaataacagttccatttcagatttacaggggaacaaactgtgataatagtaaattgaaataaactttttttagacttctgattggaacttaaaaaggaattagtaagtcttagatgttgtgcttctatcatcatcttctgaaagacatgggactgagcatgttgtgtgttatctcttggttataaccaaccactcccaaatctctcagctcttgtctagagtcttcatagtgatatagtgctagaaaggctctcttgagggtttatgtagtccagtcttctgctgcttgactgatgagtgattaatatcctctagcaaaaatctatcttacttttaaaggtctatatgtttgagttcctatatccactctacttttgttaaacctgttttagtcactattatagattagtgccattctttacagttaatgaaaatcaatattgttcacaatttctttttcagacctgttttgacaaagaagtactatcagatgtttatcttattgttactacttaatgtgtctgcacatttttattaaatgctttttaaaataaagattctcaattattttctacctgtaaaagatgtcttacaaccacccagtatttatttaaatgtatttttctgtggtttattttttattgatatataattcacataacataaaccttttatttttaaacacctacttcctcctctaaaagcaaagcttactagcattttcacaggtcctccctcaggctatggggccaggatttggtagctggtgctgagagaaaacgcttgattgcatccttgccctgggactgtgccagtggcagctgtcactcaatgggacaatttctcctgctgctctaaccttaggcaaacaaacaaacaaacaaataaacaaacaaacttaagagcctaaacctggacataacagttcaagtaacctaggattgcttttctgtttcattgtttactcttacatgtctctgttatgttgttgcttttactcaacttgaggttcatggtaatttccaaattatattcatttacataagttttatttttctctccggaagatgacagcaatactatttacctgtattttgcaacttcaggcactgtgctaggtgttttatagatattataacctaagcaggaaagtagtcatttcttaaattttacaaacgagtaaagagaggcttagaaaaattgcataatggctgatagctggcatggctatcctgaagtcctggccctttaaattttatggtgtttgtcattagtctaaaaaccttggccatggttgttaatgaatttcttcttcatgggaagaaaaatatttttagagagctagagctatataaacttagatattatttaatttttaaaatttgtaactttcttgaaatagtaatatattcaaatggttcagacagtagaaaattgcatataatgaatgcagccttcttgcctttgattccagctgtccaattttcactccccaaaacagaagatgatttagtggttactaatttcttctgtatttgtccacatacttttctttgcatgtacaagcaactacaaatatattatctttttctcctcactctctttgaaaaaaaaaattggtagcactcgagtcatactatctgtatcttatattttcacttgggggaatctttttatatcaatacagtgagagcttcctcatttgtttttactgtgacatttaattgtcaaagaaattgcatatctactcttaggtatatactcaagaaaactgaacacttataacctcagaaaaaatttataggagtgttcatagcatcattattcattatcgccaaaatgtggaaacaacccaaatatccatccattgatagtggataaacaatatagtgtatccatacaatggaatattatttggcaataaaaagaaatgaattattgatagaagtaacaacatggatgaaccttgaaatcatgctaagtgaaagaagctggtcacaaaggaccacatattatgtgtttcctattatatgaaatgaccagtatggaaccagagtagattagttgttgccaagggctggaggagggttgggggagtaaggagtgactatcagtgggtatgggatttttgtttgggttgatgaaaatgttctaaaattagatagtgatgatggttgcacagctctaggaatgaattactaaaatccagtaagttataaactttaaaagggtgccttttatagtatgcaaattatatcttaataaagctgttatttaaaaatttgataaagcttaacttttactttccatcctttcaattgttatcctaattcatataagtcagcctctattaaccagacagttataatccagagatttccagtctgtcacaaagcactatacatgatttgagttactttattagcaagcaatgtctaatgattctttaacgtctgccacttctgagctgtttatttacagagctcaccttggctaccctctggccccgactgcactgctttatttctgtgaggagccatttctcagattaatttagcataatataatctctgggtattgtttcagcttagagctgtcaggccatttcctattgcagaagttacaattattaatgaattcccaggctccagctgaaccaactttgttcctatcaacatactgtctgttacagaaatgaattgtcctcagtccaagtctgccatctgccccagactgcttctgcctagggcctggagctgggcaaatacagtattttttttttttaatctttcttctcattggtgaatacttttttagtgataatggctttttccaaatgcaattgcctctggattttgtatattgatccatatattctgccttaatggggaatgaatggtaaatatgaggaaaagttgtgataaaactcttctggagttccatctaacaactcttttctctttgtgtaatcctattacctcaaatatgtgcagagaggattttggcagtaattcaatttgtattcattttgttggaaggagtgatatcttacaatgaaatataagaatgccagaaacatatttctgacaaatatatttatctcacttatttatgcctctcttgtctttatttttcagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtaaagcaagagaataatggaacaataatgagaggaaagcttaatcattggaaatgtagattattcctgctttgtggattatttgcatcagagttttaaattatgggttgatgattttttttttttttgctatctttatccttccatttttttcttctttttccttactctgagttgatgtatacttaatgatgcaaacagtttttaaatgaaagcacacttcacaacgaaatctgcacatggtgctattctggttcttccaattttttggtggatttgctattttgtaatgcttttgctaactcttggaacctattccaagatacatatccattagttctaatgttgatcatttaaagtggacacagattaatcaattcaggataagggagcctatacaatagacattaatatctttttaacttcttgcagtttgatactatctttattgagtcatttaatagctaaaaaatattgactctttgctatatatggtacggatctgcatgctaggatatgagggtaaacaatttttcttcctaactgcacagaacttaggatgtaatgagaaagcagtcaggcattaataagacttctttccccagccttttacactaaccacatatttagcataataacctgtgactttttttttctccaattgatagaatctctagaatgcatttcctataaaggaaaggttttctaatcaagtagttttgacatttttgttatcctctctttattagtatctgtgcttgtgtttcttttcaagaatgatgaagaaaccttccatctcccaatggaaaagtgatgtgttcctagaggaaaaaatttgatggtagaaaacgggcaaatgtgtttatctgagatatgaagttaactgagtgcagtgacttacgcctgtaatcccagcactttggaaggctgaggtgggcagatcacttgaggtcaagagttcgagaccagcctggccaacatggcgaaaccttgtttctactaaaattcaaaaattagtcgggtgcagtgacatgcacctgtaatcccagctgctcaggaggctgaggcaagagaattacttgaacccaggaggtggaggttgcagtgagccgagattgcgccactgcacttcagcctgggactctgtctcaaaagcaaaaaacaaaaacaaaaaaacaaaacagatatgaagttaatgtatttggaattcctttttaacctcaaattgtcatactcattcctttttgtcatgtaaacaactgctgatatctcacaaagagttttcactctgactggacctcatctgttctgattctgcaagtggatctgtaatgtactcaaaatacttttgtttcatggtgtatgcgtaatgtgaatcagtttaacttgctttctgctttatctctccttttatttcctgtagtgatcctgcttctaaccaatgttttctttcagtgttgacacttggtaggataatctctagaatagttaatgcagataatgcctggagattatctaaagaaggattcccttgaagttatacagtgggttaccttgatctgtctacaccactgacagaaaacatatattgcatctatatatatatgcatgcacacacacacacacactcacacacacacacacacacacacacaggaaatttgatccagcatgatgctttagattgtaagtaacagaaacccatcttaagctgccacaaagttttttcccctttatttttagttcccaattaataattgtacatacttatgggatacagagtgatattttgatacaggtataaaatgtgcaatgatcaaatcagggtaattaatagtatatccatcacctcaaacatttatcatttttgtgtgtgcatgttgggaacattcaaaatcctttcttctagtttttattacctctagtatttagaacattcatggtctgggcagtattttcaaggtacagtttctttcctctgtgaattagctggaagcccaaagccttataaccttatattcaaaattcaaaaggaagagagaagtaaagaatgctcagattggccttgcttaggtcatgtgtttacattggactaaccatcatgatgggataatggggcactttacttggccatcctgggtagaatagaagtaggtgaagtatcaggtctaaaattgtttctgccaccaggttcatgtggaatggggtgagatggtcccccaaaggaaggatagatagtgtactcatcatagaagtggaaatgtgcaaaataggcaaaaaatgtaaagcagaacttctcagtttgtcttttgggggacactgaaatgctgtatatgtggtaggtgtgccgagatattatcctgtctcagcattctggcagccagttagttgtcttagctcaggctgcctgaagtctctgtctggtagcctctggccacctggtatgtagaagccttataggatgcttaacagtatcttataaatatttgtagagggaatacctaacaaaagattttattgttttggaaatcaaggctacttgtttgtggttttaagacctgagaaaatgtgttttcctcctatgtttctatccataaggtttaagggtttatggtaagattaaatacttaggtatctgaactgaacatcaaccacaaagatgagtaattttgagataggttgagttggtctaaaataaaagtgtaaatagtttaatatctcaccttcaatggaataactctaaatactatgtgtaaggtgtatcaatttctttttgactgatttataaaatagaatatgccaaagagcaaaaactcataaatttgattttagagaaccacaagttccttcctcaaaacgtatccccattgatgagtttgacaaattgagttttgcaaaactcagtgcctctttcaaattcttgttacttgcttttctcttgtttggaagtggcagtagagtcatgcttatttgttttgcttttcttttacttgcatcttacaacactgaggtattttattttctttttacattttggttgttaagtctagttaaaggtcttgcttaataggaacagttgcaatcttcgattattttattctttgtgatgttttcagagcttcaatttttttccatgtgtaaaagtgtacacatttgatccatttgaaatcacttatgtgactaggttcatgggccatgacttgctggtctttaaaaagtcatatattatcaaatgtaaaagttgagttatagggcagaaccctgtgatagttctacccagggtcaaaagccatattttaacatggaaaatgaataggaaatgtgtgaaatttaatggtctgtaagttactgctgtgagaaaaagagaaaatatattctataaaagaacttgcacaaagagtctttggacactttgtactctgttctgttgttaccgaattctatgaattgctaccccctgaagtcagtcggctacctgtattcttcacaccagcaaaaagaagccagaatgtacagtacttttaataaatagcttgatagataagaagtagtgtactactattccctggtaaccatagcatcgattatgcctggataaaaattgggatgagcctgccagcatgaagcaattaggcaaagagaagcacaactgaaatataaggtcaagttgcatgtaccctctcccgtggcaatatgtttatttctcctttgtaaaccttacatatatatctgtaggataaaaagctttcagctggcatttgatcccttttgtgttttcccggttgtgtgcaaaaagcctagagtttatacacagggaagtagttctgtgttaatttcttggcattcctgggcgttagtgttgggctgttacttctgattggtctacagattagaaattactgatggttctcattgaaggaattgtaacttttcagttcaacccctaccactgtgatgcttactaatgtactgaaacaaaatccgtttgtctgggtgtgtcattgaacagcaagcatcagaaaggatggagtggagtttgaggagaaggagtccaaaactgcattcagaacagtggagtctatctgcttccaactgatatcagggaccagtaggtttgcttctggttagaactctctaagtgatgggcttctagtgttgttgaagggctgtgagaggggaatcagagcaggctttgtggtaactttgaatttcataataggtaggaggaattttgctcaagggaaaatacgttgaagtctaccattgccagaacaaaatttttcttatttagtggagagggaagggcgaagtggggatcggtcctctccatacttgtaccgtggccagacaacctgaagtggagcagtaagttgacatgtctcatcattcttcagcccttccacagtcagcccttcaaatcaaaggccagtcttatttgaggaaacatttatttatgtctcttgaattaaaccatgccagctccctgcaaccaacttggccttgatttataaatataaatgaacagttaaggctcaccagacttaagagaaaatttaacaatgtaactaaccagagcatctgtctctagaagtaacagaacttagagagcaggaggtaatgtcctaagagatgttggaaagacactgtatatatgttttgtattgtgtataaaaatcctaccaagagaaagaagaaatttgaaagcaagagatttgagaaattaaaaatgtgattgccatagtgtatatatggagattagattagtgatttgtaaaatattcatctaaatatttcataatatagagcaaaaagatgaaattgaaaaagtgaagacattgagggtcaccttggtgttctaacaactttctaataggaattccagggtgaaagaaacagagaaaatgaaggatggaaacttaaaacacaccagaaaactctttccctgagctgaaagagaacacaaggctacagattgttaggaccgtctgaaagctaagcagcacaaatgataatttatcaataccataatatgtttccagaacctcaaggatgaagggaaaattgtaagggatttcagagaagaacaggaaaagaaaaaattacttaaaattatattgaccttagatttctcattaatagcacactgggtattggaataccattggtggattatcttccagtttcttgaaaaaaactaattttgaacctggcatatttcttcccattattctgtcttttgtgagtaatggcaataaagccctttttagatttgtgagaatttgataatgtttcaatatttcaataatttttttcttactctcaagaatatattcatacaaaattgaaaacgaatctaagcaaacagagaagaaatattgaatgatatcaaaatatccagaaaattttattagtaatgttaaataattgtttatgtaaaatataaaataggataactccctggacctaaaatcctagctaattaaaacatggaaagtgggtgggggtgaatagttgtaatatgatagtgtgaagagtgagaacatgatagagtgttttttggcaactgagtagttctagatgttgataggaaaataagcttaaatcttaccttattagtaacaatcagtcttctaaaatttccaaataatataacaaaaggaaaataaatgtttaaaaatgacgaatattgcataaaataagattttaggagctagttcaggtattcctgttaccacaattactgtgaatgaattacattcccttatcacagaaaggctcgtattgagtttaaaaaattcacttgtgtactgttttcaagagacagacctgaaattgaaaattaaatgatgaaaacaaaaagctagataaataattaagaagacacagcatgttttgggccgggcacgctggctcatgcctgtaatcccagcactttgggaggccgaggtgggcggatcacgaggtcaggagattgagaccatcctggctacacggtgaaaccccgtctctactaaaaatacaaaaacttagtcgggcgtggtggcgggtgcctgtagtcccagctactcgggagtctgaggcaggagaatggcgtgaacctgggaggcagagcttacagtgagctgagatcgcaccactgcactccaggctgggggacagagcaagactctgtctcgaaaaaaaaaaaaaaaaaaaaaaagacacagcatgttttatttatttatttatttattttttgttatactttaagttttagggttcatgtgcacaacgtatacaggtgccatattggtgtgctgtccccaataacgcgtcatttaacattaggtatatctcctaatgctatccctcccccctgcccccaccccacaacaggccccggtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcataattttttatggctgcatagtattccatggtatatatgtgccacattttcttaatccagtccaccgttgttggacatttgggttggttccaagtctttgctgttgtaaatagtgccacaataaacatacgtgtgcatgtgtctttatagcagcatgatttataaaccttcgggtatatacccagtaatgggattgctgggtcaaatggtatttctagttctagctccctgaggaatcagcacactgacttccacaatggttgaactagtttacagtcccaccaacagtgtaaaagtgttcctgtttctccacatcctctccagcacctgttgtttcctgactttttaatgatcgccattctaaccagtgtgagatggtatcttattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttatttgagttctttgtagattctgggtattagccctttgtcagatgagtagattgcaaaatttttctcccattctgtaggttgcctgttcactctgatggtagtttcttttgctgtgcagaagctctttagttcaattagatcccatttgtcaattttggcttttgttgccattgcttttggtgttttagacatgaagtccttgcccatacctatgtactgaatggtattgcctaggttttcttctagggtttttatggttttaggtctaacatttaagtctttaatccatctagaattaatttttgtataaggtataaggaagggatccagtttcagctttctccgtatggctagccagttttcccaccatcatttattaaatagggaatctttaacccatttcttgttttttgtgaggtctgtcaaagaccagatagttgtagatgtgtggcattatttctgagggctctgttctgttccattggtctgtatctctgttttggtaccagtaccatgctgtttgggtgactgtagccttgtagtctagtttgaagtcaggtagcatgatgcctccagctttgttgttttggcttaggattgacttggcaatgtgggctcctttttggttccgtatgaactttaaagtagttttttccaattctgtgaagaaagtcattggtagcttgatgaggatggcattcaatctataaattaccttgggcagtatggccattttcacgatattgattcttcctacccatgagcatggaatgtttttccatttgtttgtatcctcttttatttccttgagcagtggtttgtagttctccttgaagaggtccttcacatcccttgtaagttggattcctaggtattttattctctttgaagcaattatgaatgggaattcactcatgatttggctctctgtttgttattgatgtataagaatgcttgtgatttttgcattgattttgcaaaatcattgcaaaatcaaaatgcattgattttgtaccctgagactttgctgaagttgcttatcagcttaagcagattttgggctgagacgatggggttttctagatatacaatcatgccatctgcaaacagggaccatttgacttcctcttttcctaattgaataccctttatttccttcttctgcctgattgccctggccagaacttccaacactatgtcgaatgggagtggtgagagagggtatccttgtcttgtgccggttttcaaagggaatgcttccagtttttgcccattcagtatgatattggctgtgggtttgtcatagatagctcttatcatttttagatatgtcccatgaatacctaatttattgagagtttttagcatgaagcattgttgaattttgtcaaaggccttttctgcatctattgagataatcatgtggtttttgtctttggttctgtttatatgctggattacatttattgatttgcgtatgttgaaccagccttgcatcctagggatgaagcccacttgatcatggtggttaagctttttgatgcgctgctggatttggtttgccagtattttattgaatatttttgcatggatgttcatcagggatattggtctaaaattctcttttttggttgtgtctctgccaggctttggtatcaggatgatgctggcctcataaaatgagttagggaggattccctctttttctattgattggaatagtttcagaaggaatggtactagctcctccttgtacctctggtagaattcggctgtgaatgcatctggtcctggactttttttggttggtaagctattaattatttcctcaatttcagagcctgttattggtctattcagagattcaacttcttcctggtttagtcttgggaggatgtatgtgtcgaggaatttatccatttcttctagattttctagtttatttgcttagaggtgtttatagtattctctgatggtagtttgtatctctgtggggtcggtggtgatatcccctttatcattttttattgcatctatttgattcttctctcttttcttctttattaatcttgctagtggtctatcagttttgttgatcttttcaaaaaatctgctcctggattcattgatttttttgaagggttttttgtgtctctatttccttcagttctgctctgatcttagttatttcttgcctttgctagcttttgaatgtgtttgctcttgcttctctagttcttttaattgtgatattagggtgtcaattttagatctttcctgctttctcttgtggacatttattgctataaatttccctgtacacactgctttgaatgtgtcccagagattctggtatgctgtgtctttgttctcattggtttcaaagaatatctttatttctgccttcatttgttatgtacccagtagtcctttaggagcaggtcattcagtttccatgtagttgagcggttttgagtgagtttcttaatcccgagttccagtttgattgcactgtggtctgagcgacagtttgttataatttgtgttcttttacatttgctgaggagtgctttacttccaagtatgtggtcaattttggaataggtgtggtgtggtgctgaaaagaatgtatattctgttgatttggggtggagatttctgtagatgtctattaggtctgcttggtgcagagctgagttcaattcctggatacccttgttaactttttgtctcgttgatctgtctaatgttgacagtggggtgttaaagtctcccattattattgtgtgggagtctaagtctctttctaggtctctaaggtcctgctttatgaatctgggcgctcctgtattgggtgcatatatatttaggatagtcagctcttcttattgaattgatccctttaccattatgtaatggccttctttgtctgttttgatctttgttggtttaaagtctgttttatccaagactaggattacaacccctgcctttttttgttttccatttgcttggtagatcttcctccatccctttattttgagcctatgtttgtctgtgcatgtgagatgggtttcctgagtacagcacactgatggttcttgactctttatccaatttgccactctgtgtcttttaattggagcatttagcccatttacatttaaggttaatattgttatgtgtgaatttgatcctgtcattatgatgttagctggttattttgctcgttagttgatgcagtttcttcctagcctcaatgatctttacaatttggcatgtttttgcagtggctggtaccagttgttccttttcatgtttagtgcttcctttaggaggccttttaggacaggcctggtggtgacaaaatctctcagcatttgcttgtctgtaaaggattttatttctcctttacttatgaagcttaatttggctggatatgaaattctgggttcaaaattcttttctttaaaattgttaaatattggctcccactctcttctggcttgtagagtttctgctgagagatcagctgttagtctgatgggcttccctttgtgggtatcccgacctttctctctggcttcccttaacattttttccttcatttcaactttggtgaatctgacaattatgtgtcttggagttgctcttctcgaggagtatctttgtggcattctctgtgtttcctgaatttgaatgttggcctgccttgctagaatggggaagttctcctggatgatatcctgctgagtgttttccaacttggttccattctccccatcactttcaggtacaccaatcagatgtaaatttggtcttttcacatagtcccatatttcttggaggctttgtttgtttcttttcactcttttttctctaaatttctcttctcgcttcatttcattcatttgatcttccatcactgataccctttcttccagttgatcgaatcggctactgaggcttgtgcattcgtcaaatagttctcgtgccgtggttttcagctccatcaggtcctttaaggacttctctgctttggttattctggttagccattcgtctaattttttttcaaggtttttaacttctttgccatgggttcagacttcctcctttagctcggagaagtttgatgttctgaagccttcttctctcaacttgtcaaagtcattctccatccagctttgttctgttgctggtgaggagctgcattcctttggaggaggagaggcgctctgatttttagaattttcagtttttctgctctgttttttccccatctttgtggttttatctacgttaggtctttgatgatggtgaagtacagatggggttttggtgtggatgtcctttctgtttgttagttttccttctaacagtcagtaccctcaacttcaggtgcgttggagtttgccggaggtccactccagaccctgtttgcctgggtatcagcagcggaggctgcagaacagcgaatattggtgaacagttaatgtgacacagcatgttttaatatattcatctaagctagataatatagaatacaaagtgaaaagcgttacatgggataaagagggggttttataatgattaagtcaaatttacaagcaatgccgttgaaattaggaatgacagaattctgtctgatatcagttttggccattatcagttcaagaaagaaataaaattatgtgtgtaattagggctggtctcgaaaccatgatctcaagtgatccacctgccttggcctcccaaagtgctgggattgcaggcgtgagccactgcgcccaccctggaatatacattttaattgtaatttaggatacaaatacagttattgaggcactcataatgcatagggaagagaggctataccttgtaaaaagtcataataggggccattttttattttatacttgacatctatatgatcttccttgagtatcatttttgagcaaagaatggagtaaaatacatatctggatgtgctgtattagttctttactttgtgaaccatagtttcagtagcagtacttttctattgtatttcagatttaattttcttgttggggtgtcaaagaaaggcagtcacacacagtcacaattatgctgctacgtgatagctgtaattgaaatgatgggttatgatttggtggatttggtgggaaaagtcaaccccagaatgcctcaagttggacacctgtgttaactcctttaccagaagtgtcgagtgcagtccctttgtctgttgagcacacagtgcttctacctgaccaatgacaattttgagcttttcacgatagttgttataatagactcttaggcaagttttcaggacagttaatgtaatgaagttgggcactcagccgttaatgtatttcaaatgggtagacatggctacaaactaagtggagccaggcaggtagttaagaagtgatttgggatgatttctacctggcaggcttatggtatattgattggacttttggaagctgtgtcctgtcattcttgcttgttaccatttttttgtgagaatggattacttctacattgaaaacaatttgtgtgtttttccttttgtctctaaagaaaacaagcatgtaaatatatatatatatgacttgaattttattatattggagaatcaaatagcagtaaagctaaataagagaagtaaggacaaagtgtctttacacttccttttgaagtgtcctatagttatcttgaatgtaagctgtcttcaaagggaatttttagtagatacaattagatttagaattcatgaaaggaatttctcaagggaaaccatgtcttacttgtttttacctcctagtaaccttggacagttcttgggctttggtatgtgtgttgttgactcaattaacacataaatatattaggtgtatctaccttatgtcctagaacaaatagactattttccaatattgtcatatgttattcagactaatagatgaaacactgtagagtccagggacagggtttaggttaggttagattgcagtaaaatttcattaaatgaaatcctattaatttagagctcaggttaatttgatataggcggaattaaaacataagcaggtgttgaagctactgtttttaggcagtttgaatttgctcatttgctttagcacaatgaatgtggtgatttcaaatggtcgaattatctgttcattaacatatcagcagggactggtacttggtaacacttggctaattagtttgttacagtatatatgtgaaagtaatagaattttatttctttaacatttttctctaattccgtattgcctcctttcattatttccagtagtgtgaattattattaataataattatcctggtgacattttactttatatgtatttagtgtcagattgtgttaaatttttaatgttagaggtgcagcttgatctgcattaagtggacttatcatggaattatcattcagcttgaaatactatagatgccttgtttttaggaaatgagaggataggtgaaaagaagagggaggattgctggggaaagttgctagagggttatgagtgccaccagtggcagctccttatctcaagcctagtgactgggacttcagcctaccttctacctgccccatgtctctctctccccagtccagcttaatgtgtatcccccttgtagttggggtggacaaatggatacagtgaattggtgactccctgaaaaattgaaaagggagtaatggtctgcttagttgttttgatagtggaagtgaaggagagagtactgcagtatagggattggcttatatggctagaatttgttgaagtaaaagatgtgttagtgttccctttgacagaacatagggaacatgggcaagagaactctaggggaattgtttcaaatctcttatgatagggctgcttagaggagtgtacaggactctattgaaagaagcaggattcctaagggttgtggtctgttctgttagagagtatctcacctgcatcaagagtctaaagagaacttaatcttgcagacttgggctccttgctatggagcagtaggttaatccccttgggacctgttcgaggtgaagacaccctaactcagtgttgaaggagtgctgacattgctccctatggtgagcagattcagagatggaagtggtgtggagaagtcaagcctagcagcatcaattaaaggttgtaaggttaaggggacccctgagaattctgtcagttaactttgtggccctttgccacagagattctgaatttaaccttcctaatctcctcagtgtgggagtaagacatgtggagataatctcaagtttaggcttcagtgggcattgattgataatgccgaaccattttctgtagtagagattgccagaaggtgggttcgattcacaccttttcctttggtttccactttaaattttttttgtgtgttcctgaggtttacaagtagaagtctcaaaattcactttagcttaagctttccttggtgacatcatattgtctttaccattaatgataaattgatgaaatatcatgaagcaaaaaagtatttgctataatcaagtatgcccattctgttccttttcatgtttttcccctttgagacaacagtggaatttcactagcttgatagagaatttttggtgcctgttttaaagcactcagtgaacatttgatgagttcctagttactttttgaagccggggagggttcagacaatggtctgcaaaattgctgaggaaagtcctggaatcatttttaaaacagtagaaaaatgaagaatcatgcatgcatatattaggttgtcttagatcaaaccctggctgaagctatagtgacacatgctgttcatgaaagacttaatacagtccttctaatcggatgaattgtcttgttgtgcaaaaagtgttattacactgtgtgtgaaaccaaccatgcttcagggggaaaaattaaatcgcctgattgagaggtcactggtgaatagtaacacaagatctattaccgttattagagactctggaggacattcacccttttatggtctttcaactgctggaatgaaatattttagcggtaaatgacacccttccgggaaatccttctgaagattcattctttgctgcttgcatgtaggaaaaaaaaatcagtggcggggggtgggggtcacagggaaaaatcacattattcttttcagatcacttaaaaaaatttacctaatttgatttggtttgctaacaattgcccttaaatgtttcccattacacccttcttaatctgtgcctattaggaccgcactttatcttttgtaacatgtcatgcatgttctgtaatagtttccgcagggaaattcacgatagcatgaaagcccagacaccagggtggttgtggtttatgtcgaaatcaagattaagcactttaaggtacatgaagtgaaaagtctatctgcttattttgtttattttcttttaagggtctttgaatgcatgtacggaggattaggtgaatatatatttttagttctgcatggcaaccatactgaacagtaaatattttaagaaatattttcagaagtgaatgaataactattgatctgaggtgaagctttataacacagttattcaagtgggaaccagagttcctttccaatggattatattcattataagctgtcaatccatttgttatagtttaataccactctggaattttctgcctttttgctattgtgctgtatggttgggatttgtttttgtggggactaggaagaaacaaagtgatcagcaataacattgcaaataatttggataattttttttttgttaattttcaggtcaaatacctgactttctcttccttccattatttgatttcagcatctttcccccatttcttctaaagctttcttattttattgcccaaaagatatggaactgttaacagtgatgtgaataagcatataaattctgttagatttctcattgtctgcttttgttacaggtatcttgatgggttcattaaaacatatctgttgaaatgggggttgggaagacgaaggaataggggaaaggggatacgttgtcagaaagaataatacatagatatttgagcttcacctggaaataaaaataattttgtaaaataggagatagaaaccctttgtcaggttgctaatgagaggcttgacctagctgctgctgcagcagcatctttggggatgatgagagatgcaaaatgcactgttgctaggcaactctcttggctgcctttggagcaggttcatatgtgctaagagctaatgaatcctcatgtctgctctttgaaactgttcaaaagccaatgaagacgtacccagacatttagcatttacaagcacctggaccactcttgccatgtcatttactcattaaaaattaagttgaccatttagtgtgtaccaaatattgctttatttttcaaggtagtccaagatttgagccctagtaaatatgttttcagaaagaagcctaatatagatgacttagtgctgatgggtactatttaaattattctatatgaagtattattttaaatttgaatgcttcctgccttctcaaatggcaagtttttggagcctgcctctttcggcctcttagacattttaaaattatacctgcatgctttgttcagcccaaggttgttatttctgaagatgctaggaatctggaacccagaactaattttgtaggcggcttgtcgaaaattcctcccttccccctcaaaaattctaggcagtagccataagacaagctacagaacaagaattaaaacttgataaggggcatccatagatcaaataatgaatctaagtacttgtaagatcccacccaacctttaataatacctttccctcgggggcattgtaaggacttaaagatcctgtacatgaaaaaacattgtaaagtaccatgcaaatgctagttttttacatcgaattccatctattaataatcatctaaattcaagcattttctgttactagattattagctattaggtttattaatattttggtaatagatggtatgattatagtggaatttatttgtaacaggatttagcctatacttgttaatattttggttgcactaacctgggatttctcttagtgtcatagcacccagtataataacgtacgataacaggcattcaagaaagatttattgtttaaagaaagttgtgtaaaccttctgcatagattaaattgaattggtttatttcttgtaatatttcaaaatatattaagagattctgttataattctacaagtatgttttcctgtctttaaaatgaaaataacaaaacaacccacctcattaaattcatcatgtggattaaatgatataatccagagtataatactggtttatagtcagtgtttgatgaaagttatgtattattaaaattatagttgatttttatagctttttaagttcatttcacaattacttatctgctactgtatattccaggagcggtgctagactgtttagctagatgacatgttccttgcccctctggggctatcatcatattttattctccaagtgcatcaaaaaagagacattaattattatctgtgtgtgtgtgcacgcgcctgttttaaacaacatttagatgcaaaaaggagacagagaatagtgctgttcaatagaagtaaaatatgagctacatacgtaggtttaagttttctggcagccacattaaaaagtgaacacaaataggtgaaattaatttcaacatgttttgtttaacccagtatatctgaagtattatttcactatgtaattagcataaaaattattactgaagtatgttatatatatgtatttgtgctaagcctcccaaatctggtatgtattttacacccactgtacatcttgattcagagtagctacatttcaaatgctcagtggccatataaagctagtggctactatgttgaacagtaaaggtagtacaaattcccaatgctcactttttcaatataaatgtaaatatgtatttagaagtagtcttaggctgggtgtggtggttcacgcctgcaatcccagcactttgggaggtgaaggtgggcggatcactcgaggccaggagtttgagaccagcctggccgacacagtgaaaccctgtctctaataaaaatagaaaaaattagctaggcatggtggtgcacacctgtaattccagctacttgtgaggctgaggcatgagaatcgcttgaacccaggaggccaaggttgtagtgaactgagatggcgccactgtattctagggcgacagagtgagactccgtctaagaaaaaaaaaaagaaagaacgaaatactccttattggttttacttagctggaaatagtctcacagattctgcagtggaacagaaacctgaaacgattaagaacaggagtttttcaaatggggttttcatggtgatactaagagcgcgatggaatgtctgacaggtgtctttggtggcagaagtagccagcctcaatacctatactttgttaaccttttcttcctttttcagttattggtaagttcagttcagctcagctcacgtttactgagttcttgttatatttatagtcctgggtaaatacaagaagaataggggcaggtttgccacctgtaaggcattcacaggctagtgtgtgtgagaatgaataactgtgaccctaagtatactggaataaaggtgtgcataaagttagagtgacaaacagtacttcgagtattctttgcctagaaaggggcagacaattaccttattatccttaaagattatattttatgggtgtgaatattttctgtgtgtcaatagttgaactatcaggttgaaaaaaggaggaacatacacgaggttcagtgagcaggaggagggaatagatgtgccttgaaaaataagctgatcgggaaggcaggggagaagcatgattagactttctctcctggcatcgactgtcatctttgggcagaaaatctgtcctctgtctcattcttccactgagcctttgctgggtgctgtggccggcttagctacttcctactctgctacctactagttctatgtcctttggacatttaacatccactttagtcctatcatttttgctgaaagtaatttttagtaaaataacattttattttactgaagtaacattctttaaatctgtaacatataatagtaatatgtaaaatatccaagcaatgaaatagtatgtacagtattcatatattcccccaaaaaatgtatacacagaaatgtacacaaaagcattacgttgcacatgtttctttgtagttttttcacttatcaagatgttatggccattttaccacatttatgcagatctaactcatggtttttggaggctgccggtgttcacagcatatcaacaatttaatgtatgtaactgtttccctattgatagacatttaagttttccaaggttttgttgttgttgcatgcatctgaggccttctcagtcatctcagccttttagaacagctttgtccaaaagaactttctgctatcatgtgaatgatctataatttgtgcagttttatgtggtaaccactagtcacatgtaactattaagcccttgaaatttggctagtgtgactgaggaacagaagttttaatcgtatttaattttagttaatttaaattcaaatttaaattaatcaaattgattaatttaattcaattgatcaatcaaattaaaatagccaaatgtggctagtggctactgtattgggcaacctagctctagaatctctctcttcttctgaacaatgaaaatcaatcattatctatgctgtttattttgtatacctcaaagactatcttaaaatgtttccttgttcttttgtcttactttttgtctatagaaacgatttttatacttttaatctttaaagttgagttcaagttattcagttaatagtgcttgagattatagttgtgagtttcttaactaggctgtgaaccacttgagatgggggactgtcttttgtcagttgtgtcatcaaagcttaacacaatctcagtgtagatttggccctcacatatttttgatggctggatatgtaactcataagagagttttctgtttattattgatgctggaatactctagaagttattctttttagaaatcctaaaaaccattgttttcttaattgccactttcttttaaagcaaaatgtggaatgatcctggtttgggggtcccaaagatgactaacacgtttagttattctctaaaagaactcacaagactcagcatagagctgtaaccatgcttaagatttattacagtgaaaggatagaaagcaaaattaacaaaggaaaaggttcatgaggcaaagtcaagaagacatcaagtgcaaacttcctagagtcctttcccagtgaagtcacacagggtgtactgaattccttcagcattgaatgatggcaacatgtatgggttctttgggaaatctgctattttattaaaccccaaaatattgaatctatctagcttagttacatagttgcttacctagatgagctatatttaataatatctaattgttggagagatttcaaactcctccttctaactctggtgtaaaacacattaccaatgacagacatagtagtagaaattgcacctaattatacattatactttacttataggacattggcttttaacttttatttgactagtcagactgccaaagatttagagctcacgtggcagaaatgtgtagctacttttgtccaagaaggaaattctatggatacaggaattcagtcactatagttatcatttatgtaagtttcagaatgttagcaatggatataactgttgattatattccttttttccctgctggtagttacatattggtaatgtagccaaccattacatcatgatttaagtttttcttatactgttttctaaataaataagttttctgactctgagagataatagtcagatggctaatgagactcacctggaaataaagtttaggccaggaagggtcgtggctattttcttctacatcaaacccctcaagtgatgtgatatttgactttatcttattctagtctgcagtatttcctgtgtctttccatacttgaacctcctgtattgctgaccttattttctacatactaggaaatttatacctcagattctgatgatgtttatgtttttggcatcctagtaacctttattggatgggctaatttttctgattctaagttaacttgatcagaatatattttggagtaactttattggcagatagtagtcttttaatactttttcatagaatcaaataattgcaacattattataagatccatttgcttatagaatttgaagagacaaggaaattagacataatttatactctaaaagcatttacagtgtgctgggaacgagggacacaaaggtctatgagatgtcatccctgtctttgtggggctaagtggcaagtacatgggttttagtgttagattgctttgatacagtccgaaattcagtacaagcttcagttttccgtttgaaatgtggtgataatcatgattttctacaaagtgcttaacagaatgttatagttagtcttcaataaatgctagctgttgttattcaaggaatcactacagatcagatgctcaagctggattggaataaggctagagtgatatatcactatagaaagattgtctggttgggacctttgctagtttagatacatttctttccttgaccttatttgactcttaaaggttaaacttcaagactgtagaatacttctttaattataatgttagtatataaatataatttgaatcttagaagagtaagattatactgtttacctttttttgtgatgttgcttacatgcctgcaaattccttataagtggaggaagtaattacctttttagcacttctgtcaataaacttctttccaatggactatttaaataataaacatcataagtaaaaatgtcaagtaattgaggaaggtagaattaagtaatgttcaaaagcttaatcacttatcatgtcattttttgtagaatgaataagttttaaaagtctcttccaatattaagattattaaggaattatgtttctgtatatatcatgcaagcatatttattcttatattttatgttttatcttttcaatttaactgaatacacactattatcttaccattcttttaaaaatggcaaacacacttgtatatatagaatttagatcaatttttcctcaggacaagggcttatgcaaagttgagtgagtcagcatttgttgaatctaaggctatgagtaaaatgtgaactaagaatacacttttgtaattcaggtctagttttataaaacatgactctgaaaagttaaaagcagacactgctttggagttttgcctctcactttcattggctgatcatatcttgaattatttcattccactgataactttttctatttatactaatttattactatatatctcatatagtaataaagtatgagctatcatatttttttaaaaaggaatagttataaacattatgtattgtctcatcttctaaccatgatgaatagtaacaaagcccttttttatttctcataatttataagtagataacactacttaagattttcgttatagaactgtctgaaaaattatgctctttttttgcagcctcatgaagtgttgccaacgtgtatgtttttttctgaatccagagttgaatttttgtactctgttttttatatgcttgatttcactgagatgctggtttgtgtctctcctgcgtgtttttttctttatgttttgtccaatttatggggtgaagacttgcatgatggctctttgtttctgttatagatggcttggaatcttatgtttgctgttactctgccaaggtagaatggaggagtgaactgagacataaactcctatccacattttgccatcatctaactttgtggtctttttgggcctcagtttaatcttcggtaaaataaagttgttaagctaaatgaagttgataagatatcttctgactcttaaaaaacaatcccaggattttttgtgtatggtaaacacataacatgaaatctaccttaaaaaattctaattgtactgtacagtattgttaagtatatgaatatttttgtacggtggatctctagaactttttttattttgcatgactgaaactctatactcattgaacagtagctccccacttctccctccccaactgtctggcaaccaccattctactttctgctctaagagtttgaccactttagatacttcatataagtggaataatgcagtattcgtccttccgtggcttatttcacttagcattgtgtcctcaaggttcatctaagttgtagtatatgatagaatttttctttttaaagactaaataatattccattgtatgcatataccacactgtgtttatccattcatcccgggatggacatttaggttgtttccatctcttgagtattatgaataaagcagaaatgaatgtgggaatgtgaatatttcctcaaaatcctgatttcagttcttttgcataaacaacctcaagatcgatcatagagtagattaaaaaaaattttttttgaggaaccttcatgctgttacccatagtggccacaccttttttacattcccaccaacagtgcacagatgttctaatttcttcacatccttgtcaatacttctgattttttaaataatgttaatcccaccaggtatgaggtgacatctcattatggttctaatttgtggttggaaagggtacttagtgtgatttcagtcttaaatttgttaagacttgttttgtgatctcacacgtggtccatcctagagaatgttcggtgtgcacctgagagagaacatgctgttgctgttgggtagaacgttctatgtgagtttgttaggaccatttggtctacagtgttgttgaagtgctctgttttcttattgatcttctgtctggatgttctatccattatttaaaataggatattgaaatcatctactattactgtattgctttccattttcccctttggttctgtcaatgtttgctttatatatctgggtgctatgatgttggttgcatatatataattatcgtattgtcctggtgaattgacccatttatcattatataatgtccttctttctctcttgtgacgattttttatatggacaaccttgctgtcttttggttaccatttgtattaaatatcttctcactttcagcctgtgtgtgtccttaaatctaaagtgagtcttttgtagacgttattatagtgggatcttgtttgggttttcggaatccactgtatgtctttgattgagcagtttaatccatttacattgaaagtacttagtggtaggaaaggacttactattgccattttgttaattgcttttgtctgtcttatagcatttttttggtcccttgtttcttctcttgctgtcttcttttatgtttcattgatttgatagtgacactttgattcatcactcattttcttttcttttttctttttttcttttttttttctgagatgaagtctcactctgtcgcccaggctggagtatagtggcacgatcttggctcactggaacttccgcctcccaggttcaagtgattctcctgcctcagcctcccaagtagctgggattacatatatgtgccaccaatgcccagctaatttctgtgtttttagtagagatgggatttcactatgttgaccaggctggtcttgaactcctgccctcaagtgatccatccaccttcagcctcccagagtactgagattacaggcatgagctaccgtacccagccactcattttcttttgtgcatgttctatgtgtattttttttatggttgccatgggacttacatcaatatctaacaatattttaagctgataacaagttacataaacttcaatcacatacataaactactcttttacttctccctcctttttatgttaccaatgtcacaaattacatctttttaataaagttcatccatttacatggtttttttagttatttatacttttgccttctaaaccctataccagaattaaaagtgattcacgcaccactgttacaatattataggattctttgtttaggtattaccagtaaactttatatttccatatgctctcatgtttctgtctggagtccttctgtttcaccttgcaggactacttttagtattttttgtaaggcatgtttagtggtgatgaactctctcagcttttgtttatctggaaatatcattacttctctttgtttttttttttttgtttttttttttttttttgagacagtctcgctttgtctcccaggctggagtgcagtggcacaacctcagcttgctgcaccctctgcctcctggttcaagcaattctcatgcctcagcctcctaagtagctgagattacaggcatgcaccaccatacccagctaatttttgtagtttttttttttttttagtataggtggggtttcaccatgttggcccaactggtctcgaactcctgatctcaggtgatcctaacacctcggcctcccaaagtgttgggattacaggcacgagccactgcacccggcctctccttcgtttttgaaggatagttttaccagatatagtatccagtatcttggttggcagtacctacccacccacccctgcccactcctttcagcactttaaatatattatttcactcccttcttgctggcaagatttctgctgagaaatctagtcatagtcttataggggctcccttaacagtcccatgattataaattaatttgtttatcaaggaacttaaacgctggaggagggaagagaaagcattgagttatatgaagccagatcttgagacagtcaattataggacacttaccagcttcttttatattaaaggcgaaatctgagcattcattgtattttcagcctctgaagggtataagattcaagattaggaggatcaagagctggtaattacatctcaagtaaatacatattcacaaggaaataataataataaaaaattagtccatcttttatgtaaaattattttccacagatgtctatctatatctgtgttttcctagtgaaacagtccctgttttattttttccatttaattggggactgaatttgggctattatgccttgagaactgtattaagtctaagattatttactgtaaacatttccttcttttttcatttctgaactggccagaggaaaagacacacccttacgtgctttttttagggccaagtctcataaaggaactgtgtactcttagacataaatacagtactttatttctcccctgacagtataattatagcatttgtttaaaagtcacacaactaaatacactagtttataaaatgtcagtaaatatactcattgcccttctaaaaactaagaatctgtcattgtgtcttggtagaaatctttctagaaggggataatgcgttgagatcactgtaagccaatttaagataaccttctgtttttaattaaaatgggaactgaaaagtcagttcaaaaatttgtctcctttcatttgccgaaagtgagagtgatagaattcctgttccaatcaagtctctgcacttgttaaaaacatcatacattttggctgtctgttgtgagatcatagctattacatgcacagctccacatgctgctgtggtatatcgtggtcagggtcattaatgaattaatgtttaattgtcaatgtcttggtggtaaagttaagaggatattttttcctttttgaaattgaattaaaatagatgtcttcgaaggttagaaggaacaggctttctaagaatagaacagatagagaaaatgaacaaatacagtgggcccttgatattagctggtttttcatctgtggattcaccagctgcagacagagcatatttggggaagaaaataaaaataagaatttagcaataaagataatatgaataaacaatatagtacaacaactatttacatagcatttacattgttttaggcattataagtagtgtagaaatgatttaaagtgtatgaaaggatgtgcataggttgtatacaaatacctatgccattttatataagatgcttgagcatttctggattttgctatccatggaatgaggtgtgcgtatctgtgtgtctgaccatcctggaaccagtccctgtagatactgaggaatgactgctggacaataaacttttgaaatatagcatatggcaaataaaattttttggcattacagtttgtgctatcaagtaagtgctttgcttatagtagatatttaccaaataattttgaattgaatttaaaaaaccattaaaatataatttacatctcatgtaattcatccatttgaagtgtacaattcaatggcttttattatatttacagagttttgtaaacattactacaacgaatttgagaacatttcattacccccgaaggaaaccccatgcccataagacgtcactgcctgtttcacccttcctgaccaccccctgcttcttacttgccctatcctagacaaccactaatctaccttctatctctacatacagccttttgtggctgttttttttctcttaccataatgttttcaaggttcatccatgttgtagcatgtatcagtacttcctttatttttatggctgaataatatcctgttgtgtggttatattgtattttgtttatttattcgtcagttgatgggcattgggttgttctgggcattctgctcatataaatgagatcatataacatgaggccttttgtggcttttttttctcttagcataatgttttcaaggttcatccatgttgtagcatgtatcagtactttatttatttttatggctgaataatatcccattttatggttatactgtattttgtttattcatcagttgatggacattgggttgtttccactttttggccattgtaaataatgcttttctgaaaattcatttacaagattttgtgtggacatatgtgttcttttttcttaagtagataactaggaatagaattgctacatcacatggtaattctatgtttacctatttaagaaattgatagaatgttttccaaagggactgaactactttacattaccacgagcagtgtacaagggttccaatttcttcacatattcggcaacacttgttattgtccatcttttgatgatagcttttgcatcatgtgtaaggtggtatctcatggttttgatttgcattccatcatgtctcatgaaattgagcatattttcctgtattggccatttgtttatcatctttggagaaaggtgtattcagatcctttgcctattttaaaaccttttttttgggtaaattattgggttttaagagttctttatatagtctgggtacaaatctcttattagctatatggtttgcaaatattctttcccattctgtacattgtcctttcactttctttatggtatcttttgacggacaagcatttttacgttgatgaaattcatttttccttttgtggcttgtacttttgttgtcatgtctaagagcttagtctaccccaatgttacaaagacttaatcctatattttctttaagagtgttatagttttagctcgtacatttagttctaaaatccattttgagttaatttttacatgttgtatgagaaaggggtccaacttgattcttttgcatgtggatatacagttgttgaattccagcactatccctccgagagactcttctttccttattgtttttttctggggatccttgtcaaaaaccaattgattataaatataagtactcatttctggactctgaattctatttcattgatttgtctttctaatcttatgccagtaccatacagttttgattactttagctttgtggtaaatttggaagtgagaagtttgagtcttcaaactttgtttttctttttcaggattatttagggtatttagggttccttgcttttacacatgcgtttatgatcagcctctcaatttttgcaaagaagccagctggaattttgataaagattgcatttaatttcaagatcaatttgggaaataatgatgtcttaacaatgttatgtcttctaatccatgaatgtatttcttttcacattttattgtgtcatgcatagagattgaaatgaggacttagagggaaatttttgtccattggctcctttatagtacactgacttcagttacttcttattggagtaacctaattgaatgtttcattatgtgaaattttattgtttacataccttaagtgttggctgttcattagaactttacatttctttgaggcaggatatatctttttatttttttgagacagggtcttgctctgtcatctaggctggagtgcaatggtgcaatcatggctcactgccacgttgagctcccagtgttaagtgatcctcccaccttaccttcccaagtagctggggctacaggtgtgcactatcatgcccagttaatttaaaagttttttgtagagacagggtcttcctgtgttgcccaggctggtcttgaactcttggactgaagcaatcctcctgccttgcgttctcaaagtgctgggattacaggtgtgagccaccatgcttggcaaggcagggtgtatcttaactactattgtatttctcagaagtgatgttatagttattcaataaaagcacttttcgattggtgtttggcagctaattataagtggtagaatactagtgacactatgaaattatcattagcaagtaatagctaactgatatattctaagtcttccaattcattcatattcatattattcctctggaaaaaaagagataaatattccattatatattacttttttgtaacaaggcatatttaatatattttaaaaattcattttaggtgccaaatctgattccagttttgatgttcaaattgggaagaccactggaacctatattatataatgatatattgtatactttacctaagcttggtgttcacaaggttagtatgttaattaatttagttggcgaaaaaagtgagtcatgaataatactttgaattctttttggtattatgaaattttaagccctaaattttgccatagtcactacttctcttgttgagctaggaggtaatatctaaagacaaaagtatttattacaatatttaataattaattgttttaaattacttagtatctaagttttcactttggctattctctgagattaggtccttatgtccccaggattgttatctagcccctccaacgctatttttcatcctctaagaaggtgggtaatattgcagcaagctttcttctcagtcttcattttataacaaggggtttaaaaatgcttttggtaacctcgaggttgtctgcattcaagtttatgcaactagagtttcttcaatattttctaggtgtgtataggacaaattctacgaataatacaactacttggaaccacaccacgactaagagctgtcactttgcgcttgctgacatctttgtgggaaaagcaggtaatttcagatatacacttgcatgagtattaaatatgttcctttcactgaaggaaaataattatgtcatatatggcaatgctttggtttagtggtattaatgagtggcatcagtgattgcattgaaaaagttttgatttattgtgatgcatttgtaatgcagttagttaactttcagagaaattgagaatataaaatctcatttctttatttctgaaatgtatctttccatttgcttgagaaagtaatggaaatatagttataaatgattagagcctttgtaattagggtgagatttagccactttcttcttgttttatgaaatcaacagtacattggtgtataagaaaatccccagtaatcactatagcaatcttctctgctgattagaagaacgacagtataatttgcaatgcaaatggaggatttggaggtgaaaatgctgagtaaaaggaagataatgattattcaactcaagttgggaaactaccttttttgtaaaattgccttcgtaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggtatgatgtcattaactcttaggaatgtatatcatgatatattattttgtatttaattttttaattgcaagcaagaggcaagaaaagataggcagaggatatataagtactaataattttttaacttaagttttctgattataaaatgtaataatattgaacaatagctttgagaagtatgtcttttcttttcaggactagtcttgtatctaggttcgtaggatatttatatcgttttctgattaataatttaatattgcagtaaaacatgtgatgttatgttttctatttttctgtatatgaatccctgaaaactacacagtagactgttgtcataaactattctttcttatattctccctttgtttaagtagggagataagtagttttaatggggagaccttatttttggaaatggaattatttgtaattataacaaggaagaaaatgatgatgaatttttatgtatgctgtaagcttttaggaaaacataaagaaattaggaagatgactctgctgttctagattatggattaataaacagggtggaggtgacaagactgaaataatacaagtcaagctctaccatatccaaatttttttttcttgcatgtggtaagataaaaatgtttacagaagaaatggacttgatgcatttgaaactgtagtcctgcagtttcatttgttgatcagccactgcgttgaattcctggtaacgtcattctcacttttgttaatgacagcagtgtgaatgctactctctgaagctgtgcagtgggttggcccagatgctgataacatggatgattcctgtttcaagtaaaatttggatcagaatatacagaagctaagccctagcatttttacctcttttctaagcttccatctttagcaacacaaaaatgacctcaatgtaaaagttactaaaaaaaaaaaaaaaaaaaaaaaaaaaggagttacatgtgtgtaacccaagaattgggagtttgaattttactgagctattggcatggaaaaaaattcagagataaaagttattggctgacattcttattctatataattaaagctgaggctcaggatagactgaatatcagaccagatcagtctactgctaacttatttagtattcctttcagttactacctccagatctgtcaaattttttcattttggaaaattatttccacttgtgggacagtgaaacaatagatttctgacaggcaatttcatcaatttacattttgttaataaaagaaaagatattattgaaaggaaacaaggaattcagggaatagacttgcataaccatgaaattaatggtattctggggatagcacaatatatgtggattagaaaggagaggaaggggaggaggatgagtgaatgaatttagcacagtgcctggcatgagataggagctcagtcggttatagtttttataatttttatccttatcatcattatgataggtgtaaccaccctagttagtattgctactaccacaaatcatcttctgttttcaaattcctgcttttgtaatgagtatctgatactatcaggccagaatagctctatctttactaatctcaattaggtaattcagttctttttaccattattacagccttgagtttttctcaattcagacaataggatttgtgatttagagtgaatgaaatttgttaaaaagtgtctttttgggttatttctatataaaaacgagcataaaattatagcagaaaatgatcatgatgcacatttttgaagaaaaaacatggtgttaatatttgagggtcaccatttagtggcacaagagtatagaaaatgatggatgctttttgtttaggcaaaagatctgggagtgataactgcactttagcattaattttgcttttaaactttcatttcttgtaggccatatcaacatggtgcagatatgttggcagctatttctcaagtgttgaatgaatgcaccaagcctgatcaagctactccagcagccttggtattacagggtcttcatgcactctgtcaagctgaggtaggcatttttaaattgctttggataattttgaagaaaatcttttataaggcagagtgggtacaagaatgtaagattagattcaaataactgaagtctgagtgttcattcccagtgaattttttcttggaaaagtgaagcaagacctactttacaaattctttctagaagggaatcttgaaacatccagtcatgtaggcattctctagagatcaaagaaaaccagacttaagatttttctttcttcttatttatttttgttaaaacaaaagggaaagttatgcctataggagaactctagaatatagttgcttcttaattttgtgattagagagctttagaaacaggtgaggtgaagaaattgtcgttggccagtggcacttttatagctaaaagattgggaaagaaccattcattcctggtgattagactgagtagggtgggtaaatgttagaactaaacttgtaaatcattttctgaacttcagactgttcccagaattataacacagcagagagaatctactgttttagagaaatgttttagagaaatgtggtaattgcaccaaagatcattcattgacctaaccaaaggttttgacttagtgaacatatatacccaattgtagttttttagtgaatgagactaagtagaattctcccaccttaaggttatggtcagttatggttgataatgatagtaatgaatataatgatctgataatataagtgacagccatattgagcgttatgctcgtgtccttgggctaagcactttttatgtatttttcttaacaactctgcagtatagggattaacaccattttacagatgaggaagatagaccccagagagaggttagatatttacgccggatcttggtatgagaatacacttctattatttttggtgaacactcatttcagcaggcagtgaacatcattgctgtttaaaaactgatgtgtggtaaggacaatgctttcacatcctgtgcccaatatttggaaaagttgttagaacttaatggcaaggggctattatagcaggagaataccacacatgcccaaggacatttgattttactgcttctgtcagtcatctgagattgggaaatatctctttaatagttatattactttcataataagtaatcctgaaatctatttttaaaccagttttgagagaagaaagaattctaaactttcaccaccaaaaggtgaccatttttactgttttgttgtatttccttttcattattttttcctaacaggcatcaactaatttctgaaattaacattttttcttataataaatagtaatttagccttattgcttttatgattccattgttttctctgcccatcccctcctgttactataaggctgtacagtttatcaatgctttttaattcataagaaataccctgagtttggcactgactttcctcattccatttctctaagacatcatcattaactgtggttagtactgaagataaatttttaggcactagtgtacataatatatatcagttgttctatgtgtcctttgactaatttagttagcttctctgaaactttgttccttcaaatgaggataaaataagattatacacaaaaaagacctagtgtaatatctgctcacataggtattaataataaagcactaccactaattagttaagttcattttattagaaaaagaatgcttattttcttacctcttgtttttcgtctgttcattcttgtctagaaagtaaattattttatcgatgcttactaaagcaaactattttattgatgcttactaagtgttatataccagttttctttatagatattaccaatgtccagaattgtggaatttgttgaaaatgactgcattactattaattttggtgataatttttttttaatgtttggtaatgaatagctgtgtgtttaaataagtagatgtaatctattttcctttgaggcttgatgatggtagtaatatatctttctgttttgtttaaggcttttcaagctttgcgtgtgtgtgtgtgtgtgtgtgtgtgtgtgtgtgtgtgttcattatttgtgaagctgctgctatgtcctgtgatgtgtgttacagtcataaagtatacttggtattcaccagctcttgccaggccacatttactaactgggggctcatcttttgttttgtgtccagagtgctattcacagaggtcagctcgcattctgtgaagccagttattttgttttctaattgatatcatgtgtgaagcgtgatgtagtcaaggtttcaagaaggaaaacattcagcatagttataaatccatttcctggtggcatttggtaatgatttgtctatctgttactgtttagatccttgactatcaaatataattaggtatatagaaagacagcctaatttggtaaaataaaacaaattaataaagataagagaataaattgaataactctatctttaagaaaataccttagttggaaaagtacccagaattggattttgtagggctttcccaactttgcctttgtaaaataagtagtgcttttttcacccttaggtttgaaaatgaactctttcatcttgaaagttataatcatgaaattcttttgtctttgcttgcatcagattaagtttagaattattgctgcttaattatttatcctagacatcaatcaaagattaaaagagtggattctgtctaccttccaactctttcaaggtaaagattgtgttttcaatatgggtttctttagtgctactttgctgaacaaacaacagagagggaaggttgtaggaatcttggctgaccataaaggcaagaatttagtctggctgtctggaattggtaaagagaaatttgtcccttccttaatgctgttgatgtattgatttgggaatttacaagtttgtttttagggctgaattgcttttaaaaaattacagctactatttcttgggttctgtaattgttaatattgagtgtcaacttgattggattgaaggatgcagagtattgttcttgggtgcatctctgagggttttgccaaaagagattaacatttgagtcagtggactgggagaggcaggcccaccctcaaactgggagtgtagcatttattcagctgccagcatgactagagtaaagccggcagaagaagttggaaggacttgacttgctgagtcttccagtcttcatctttctcccatgctggatgcttcctgccctcgaacatcagactccaagttcttcagcttttgagctcttggacttaaaccagtggttttccaggggccctcagtcttttggccacggatgaaggctacactgtcggcttccctacttttgaggttttgggactcagactggcttccttgctccttagtttgcatatggcctattgtggggcttcaccttgtgatcgtgtgagtcaagactcgttaataaacttcccttcatacatacatctttcctcttctgtccctctagagaaccctaattaatataagtacctagtgtgaatttggacattttatgatataggggttgtaggacttcattttatattgaagaaacagagcctctggcaatttaatacatggctcacaaaagtagtctcaagactcttcccaagtctcatgctctttggttactcccgggcttgtttcctttgaaaaatgtgggcattgaaagtagtagttttatttatcattacgctatgagtttgtcattttcaaaggaaaataattaatgttcctgcattctctttttcatatcttttccattgagctttctcatcactttttatcccagccaccatcatttgccttaattttcttacttctttctgtcttaatacagaataatggctccaataagaaataatcttttttaaaaagcaattttattgagatataattcacaaagcatacaattcattcatttaatgtatataatttaatgagtttaagtatattcagagagttatgccaccatcatcacaatcaattttaggacacttttaactccccacaaaactccataccgtttagatgtcaccccctaatctccatattccacatttctcctagccctaggcaaccatgagtctactttctgtctctgtggatttacttattctggacatttcttataaacaaaatcatatgatgtgttgtcttttgtaagtagcttctttcactcaacatattttcaaggttcatccatgttacagcatgtcagtactgtatttctttttattgttgaatattattctgtttggctctaccacattttatttatccacttatcaaatgatggacatttgccactaacagacaaatggataaagaaaattgtggcgtgtgtgtgtgtgtgtgtttgtgtgtatgtatgtatgtatacacaccatggaatattattcccccttaaaaaaggagatcctgccatttgggacagtgtagatgaacctagatgccattctgataagtgaaataagacagacacggaaagaaaaatattacataatctctcctgtatgtggaatctaaaaataaagaaagagctccgatacacagagatatagaataaaacagtgtttaccacagcagtgagagggaagaggaaataggagatgtacgttaaaggatacaaaatggaaggtatgtatgaacaggtttagatatcgaatgtaaaacatgaggcccaaggttaataaaattttattttgttaaagatttttattaaataagtagattttggctgggcgtgttggttcacacctgtaatcccagcactttgggaggccaaggtgggcagatggcttgaaaccaagagtttgaggctagcctgggaatcatggcaaatcttgtctctataaaaatatgaaaaattagctgggcatggtggcacacacctgttgtcccagcactcaggaggctgaggtaggaagattgaggctgcagtgagccatgattgcgccactgcattccagcctggatgaaagagcaagactctgtctcaagaaaaaaaaaaaaaagagagaaaaagtagattttaagtattcttgtcacaaaaaaagtaactatgtaagatgatagatatattagtttgctccactgtcacagtcattttactctttctttgtattccatgacatcgtgttgtaaatctcaaacataaacaatagaatatatatttagaaattgatggacattgggattgtttctatttttggctattttgaataatgctgctatgaacatttgtgtacaagtttttgtgtgtatacatattttcattttggtaggtagatctctaggagtgggattggtgggtcatatagtaactcactgtttaaccatttgaggaactgccagactattttccatagtggttgtgcaattttacatttgcaccagcattgtaagaaggttctaatttctgcacatcctcaccaacacttttttttccaagaaagtgattttatttttaaaaattttgatttttattttaagttctggggtacatgtgcaggatatgcaggtgtgttacataggtaaacgtgtgccatggtggtttgctgcacctatcaaaccatcacctaggtgttaatcccagcaggcattagctatttttcctaatgctctctctccccgcaacccctcccctgacagttcttggtatgtgttgttcccctccctgtgtccatgtgttctcattgttcaaatcccacttataattgagaacatgcggtatttggttttctgttcctgcgttagtttgccgaggataatgacttccagctccatccatgttcctgcaaaggacatgctctcattcctttttatggctgcatagtattccatggtgtatatgtaccacattttcttgatctggtctatcattgatgggcatttgggattgattccatgtctttgctattgtgaatagtgctgccatgaatatacgtgcgcatgtgtctttgtaatagaatgatttatattattttgggtatatacccagtaatgaaattgctgggtcagatggtatttctagatctagatctttgaggaaaaactgcaccttccataattgttgaactaatttacatttccaccaacagtgtaaaagtgttcctatttctccacaactttaccagcatctgttatttcttgaccttttaataattgccatcctgactggcatgagatagtataaacttgtggttttgatttgcatttctctgatgatcagtgatgttaataccaacactttttattatctgtttttttttcaaactatagccatcctaatgagtgtgaagtgatatcccatgtagttttcatttgcatttccccgatgactaatattgagcatcttttcctattatttttggccacttctgttacctttctggagaaatgtctattcagatcctttgaatattttcttcattgcttttaacaataaaaaaatgtaaatgatgaataaaagaattctgtcctgatgcctctaagtaagagatactggaaagcacgagcttggtttgtgggcctttcactacaaagagagcttatcaaaccataggagagatcagatgaacatatatcatgctcttctttgctactttgttcacatgtaacattttctttgtttttatatgaaattagcataatgctttcagctggaaaactgctaatgttttaataatatttgtagcagcagtagtaagcatctcttgatttactgagtactttctatatagttaacagcatatatataataaagtcattatatttattatctcatttaattcttacaatagaagaaaaccccaattgtgacaggtaccgttttcttctgagaggttgacaaaagttgaataattgcccaaattcatacaactaaaatgtagtagtcaggactcaaacctaggtctgtcttaatacagtttttattaagataaaattcacttgctgttattatgtgtttttggtggttgtgtttgtgttcactttaccttgtcatgttgtgttattggagaaaactttttttgagaatgatacttggactttttttctgtccttctccatttcctttgcgattggttaatgtataatgttttgcattattaagactttgcctaaaggtcttaatgaaaaagatgttttgagctaaaatatattaatttttagtgttttactgattgcatattacactttatattaaaggtgtgtggaagtgtttttatcccatttccaaagatgttaggtttttaaagcatcacatttactttgggtaatgaaaaaaagtagtatcacttattagtctctcacaaagctgttttcattttttcatatcccttttcattgtattttctttattcattatttcacagagtttctgtgttctctaattcgtttacattttgctagaaagatttttgatgtagcgacatattttaatggcttactttccgttgaatgaaaatattagtaatcaatgattcatttttgattgaatatttaagttgcttcccatttttctctcttatttgtttatcgagatggggtcttgctctgacggccatgctggagtgcagtggtgtggtcatggtccacagcagcctttatctctgggtgcaagggatcctcccaccttagactcctgagtagctgggactacaggtgcatgccactatatttggctaacttaaattttttgtagagacagagtctcactatgttgaccaggctggttgtcttgaactccttggctcaagcagtcctctcaccttggcctcccaaagtactgagattataggcatgataatctcatgcctggcctatgactacctttaaaggatgtttttgaaattcattttattgactagggatcttatttaaatccgtagttttaaagcaattattctgtgttttttttatggacagccttttcttttaaaagaagatgaagttgtcattgtgttgttctagaggtatttgggtttgtggtttaagtatacaagggatcctcttgatatcataatctcgtaaaggttattgtctgttcccaaagatgttcaaatagaatggttggcagcctttcagcagtgttcaggccagttatcatttattcattctccggtaggaagaggtggtgaggagagcaagggaaagtacattggcacagcttctctttcaaaccctgtctgttgcaacaacaaacatgaggtagagatttctgtaggtaggacacaaaatgtgttaaccttaaaataaaaatattgaaaacttgagccaggctgtgcaaggctttctgcatataaagatttatgagacatttttggccttctaggagctcacagtctggtaggggaaacatggtgttaagtacactaaatgtatttaaaatttagaaatgttcgggggagagatagaagacacatcaacagaatatttcaaaccttaagcagcatcctcaggttgcagagagacagattaggaactggaggaaagaggctcaatagctcacctgtatgtttcttttttctttatacattctgtgatattgagatataattcataaatatacaattcacctatctatagtgcataatttagtgactttttgaatagagttttgaaaagcttactaaaatcaattttagaacattttcattacctcagaatgaaacccacatcccttaagcattgaaccccaatcctcccatacctccctgctttagggaaccagcaatctactttccgtctgcatagatatacctattctggacacttcatatggagtcatacaatatattgccctttgtgtttggtttttcaattggcataatgttttcaaggttcattcttgtggcaacatgtatcaatactttttatagtgtctttttagggttgagtaatactgtgttgtatggctgtatcagttgatgaacatttggcttttttccatttttttggctataatgaataatggtgctatgagccttcatgtacaagctttcatgtcaacgtatgagtttcatcctttttttggtgtatatctaagagtggaattgctggatcatatgataattctatgcttaactgttttgaggaatgccatactgttttccagagtagcagttctgttttacattctctccaacatgtacttttcttctgttctccccaaataagtcagattctcctggatagatgttaccactgaagcattttagctgttaccttcattctttttttttaatttttaatttttgtgggtatatagtaagtatatatatttatgagggtgcatgagatgttttgatacaggcacgcaacatgaaataagtacatcatggagaatggagtaatcatcctttcgagtatttatcctttgagttacaaacaatctaattacactctttaagttattttaaaatgtacaattgagttattattgactgtagtcactcaattgtgctataaaattcttaatcttattcattctcttttttctttttgtacccactaaccatccctgcctccctaccagtcctccactacccttcccatctttctgtgtctggcttatttcacttagcataatgccctctagtttcatccatggtgtggcaaatgacaggacctccatttttaaggctgaataatattccattgttaatatgtattacgttttctttatccattcatcagtggacacttaggttgtttccatatttgagctattgtgaataatgctttaataaacatgagagtgcagatatctttgtaaggctgtgatatctttatgaggtagtgactaataaacgtgggaatgcaaatgtctttacaaagttgcatatactactttgtgtatatacccagaagagggattgctaggtcatatggtagttttatttttagtttctttaagaacctctatactgttttctgtaatagctgtaccaatctgcattcccaccaatagtgtaatagggttccctttttccatcaacattctatatctcttatgtttctgataatagtcatcctaaagggtgtgaggtgatatctcatagtggttttaatttgaatttccctcatgattagtgatgttgagcaataggtatcatttttcaagagttaccaatagcagtcctgaatggtttaatgtttattataataaggatgtttgtcctggtataaaagccactaacatttatataaataaaagtttgaaaacttatggcttattttctttgattattataggattaatatttttcaaattgattccaatattaactaaagataaacatactaatatctactttctcttgataagacaggaagatctcgcagtacctggcttgctttttcacatggcagcgaccacttggtgctaagtagcagttagaagcttcctttagatgagtgtgctttctaatttggtgcacttctctaggcttatagatttacatcatctgcctgacccaagtagtccttcgaagtgtgtcctttattttagcattgcaagtaacttcatatgtgatctcaatttgtctctgtaacaactctctcttcaacttcacaaactgctcttcaaaaaagttatatgattgactagtaaacacatagaaaaatgtcagcatcactggtcattgggaaatgtgcacaccactggaatcactaaaattaaaaagactgacaatactaaatattggagaatatatgaagtaactggatatctcatatattgtaaatgtacaactactgtggaaaagcattatgcagtttcttataaatatgaacataattctacctgatgatccagcaattccacttctagatacttacccaagtaaacaaaaacatgttcaggtaaaagacttgtacggaatgttcatttcagctttgttaaggatagcatatttgaaaaaaacaacttgatgttctttattcaggaatactgtgcagtcataaaaaagaacaacatcatgtccattgcagggacatggatggaactggatgcccttatcctcagtaaactaacacgggaacagaaaaccaaacaccgcatgttgtcacttataagtgggagctgaacgatgagaacatatggacacacagaggggaacaacacacactggggtctgttgtgggggagggggagggagagcatctgagaagaatagctaatgtgtgttgggcttaatacctaggtgatgggttgatctgtggagcaagcatcgcacacgtttacttacgtagcaaacctgtacatcctacacatgtaccttggaacttaaaagttggaaaaaagaaaagaaaacaactcgaataaccattatctggtcaatgggtaaacaaatcgttgtgtatttgtataatagaatactagtagcagtgaaaaggaatggaccactgctacttgcaacaacacagatatatcttgaaaacatgttcagtgaaagaagccacataccacgcgattccttccttatgaacttcaggaacaggcaaaactaatctatgtgtgtagaaatcagagtagtggtagtcttggggtgggagtagggagatagaccagaaagggacaggaggaaattttctggactgtggtttatatttgcaccatccagtataatagctgttagccacatatggctagtgatcacttgaactatggctaatcccaattgtgatgtgctatacatacaaactatataacattagtatgaaaaagtaaaatatcttattgataatgttttaaaaattgatttcatattgaagtgagaatttttggatgtattgtgtcaaataaaatatatttaaaataattttaccttttttacttttcagatgtagttactagaaaatttaaaaggatacatgtggctcacattgtatttccttggtctctattttaattgaggtggtaattatacctttatacctgtatttacatacttgtcagaatttatcaaactgtacaattaagatctgttctttttacagtatgttattctacttcagtaaatcaaaagtataaaagctacctttttttcatgccatgtacaatgtttggtgtttggtgtgcattacgtcctgtattaaacttcataataatcttgtaatgtaggtgatatttactaatgggtttagaaagtctaagtaacatacccaaattaacttggaaatgtgttgtaacatggagatttggagatattctttcatttgactataattcttatggttttgcagttgtatcatgttgccttattaattgtgataaaagtgtgagtgtagtttaggaacaatttaaattttactatcagccattgactgatttctcaacctgtgctccatgttgtggtgaatgagtcataatatttctgaaaggtaattctctaactgggtaagaatcaagtaacattgctactgatgtttcaaggagaaaaagaatgttcagtctaaacaaattgtccagggttggagaagaaatacaggatgtgccgaaattaaaatcaatacattgttctgaaagagagagattaacttttaacattttgtctcccaaagtcttgagatgggaatgtgaggcagtgccactcctgtgttttcctaatcagctgtgagtctgttgtagcaaaaattaataggcgttgcaagatcatgaagaaaagctctttcatcttgcccagctccaagagggtgctatattttcaaagccaagcattgtatgattgagcaatagataaggaggaggggcggcctttcctggggattcttgaccgctagaagagttcatttcaggccatttgtcacagcagtgatttccccggaaataccctgtgccaaggttatgttttggctattctatccccttttatttatttactttctgaaatcatggtggaagatagttgtccctgccctctctcatcatcctaaccctttgtctaggggctcctttggagcactatggggtgggaatgattttcaatgggactcagcaggtttgcaaggttttagggagttagtgtggtataaaaatggccaatagaaatcctgcattttgtttaagcattttttagcgtggtaaatataatttaatatggaaatgtgatccattgtctgatggcaggttttctcagctgtgtacagtaaggcttctgtcgcctactgtggattcagtatttattacactctggaacctcttttgttgttcttatgttttgtttgtgggacttttaaaggtggattgcctgtctaaccttgcagaagagtttattaaatttaatttgctatgcattagagaatgaatttgttggtctttttgaacagcgctctatgttatttgtagttggggcatgtttttttgatgccttcagttcttcctgggcatgaaaactctttttgtacatttgttgaatctatttccatgctgagctttttatatactacacaatgactctttgcagtcgaaagttgtagtttggccttatttttaactttaaaaggacagcaggaacttaccttttattaacattcactttgtcaccctgcaagtagatttttaagtatggtttttcattatcaaaatgaaattttaactgactgtgttattttttttaatagaataccattcagtacacataagtcatatatgaaacgggtagggaattaaaaaatgaaaggtttgttgcttaaaaagaaaacaattatgttgactgctctttaattgattgttttattaagaaaaatttggagatcatggaaagttgaatgctatatcccaacttataatgggaaaattttaaatggaggccttaatattttaccacttaaaatttttgcttctatcctccagtccccttttctctgctctctgccctttagtattcccagatttgttatcatcatttaagacactttactctgaaaatttacaatctcaactttcgaagttactacatttaggatctccattgcccccgtgctttatttttatccattttgggggtttattttgtgtctcaaggctttttgtatgaaaagttctctcacttgaatcaaaatcatggtctctgaggattattagctgacatgagtagtctgtgaccaaacctgaaggctgttcagggtgtccagccgtgagtttccggctctcagtcacaaaccgagggcattctttaaaagatcaaacaagctggacactgggagggttttaatgatgccagttaacatcagaggagctgggctcagtggttgcaaattgtgctcatctgaataaatgccactgagctggaaataatgacatgactaaaatgatggtaattgtgtgctgttctaccattccagtgaataaaatatactggtttaagcttatataatgggtagggtttttttttgggaggggggttggtaaatggggacagggagtgtagagacagagtcactgaagtagggcagtagacaaaatgacgttaatgttttgaaaaggttttggaatttgaaatctgattggaagcattatgtttgtacaagaattattatatctgtttttaaaagtattttattcagcatgtactctcaaatgatctagaattaaacttttataaacaatggtgttatttgttgggcttaaactcgtttctgtgctatgtaaacatgtccataagaacaagaccatcccaccttctccatgcgtaggataaaataactaagagactcatttctaaaaactctagtgataccaaattagacttaaccttgattatatgaataaaataacatatactgaaattgttaatgaaagaagttaacttgcttaaaggaaatttggaattaagacagcgagactggtaagtcttttcatagttatataatttatcagaaagcctcactagcatgcatataagcccagaaattgtatttaaacaatgcaatgtataccttttcttttaaaggtgtttatttttaagtttagaaacgttatagttgaaggaataggatttcttagagtttgtggtctgtactattagttggaggtcattctaaagcctttttcatgttttgagtatacattagttatcttttgtgatttagatgacattataccacataggtctttttttttttaattttgagctttattaaaagctgggcttatttcttttcacaatagcctggtggaatgtattatgccttaggttctaaattcagcagtaatgagtaagatgttctctgggggagaacattctttttgcttcagagccatggcacactgcctctacttatgtaaattgtcatttgagcaatttacttgcttaaacaatttacgaggtcatatgactttgatctgaaatggtagaataacaggtcaaacaaagtgatgtcattgaccttatttcatttatgctacacttgtaacctcaataggagtgcatttccttctattccacttgtttggctcaggtactctatccatgttatggacttcatagaaaagtgattggcagtgacttctactatgtagagtaggatctccaaagtttatagatagcttaggctactgaatccaaatctctagagataaagcttagactgtttattatttgagttccccatgactttgatgtttagtgaagtttgggaccattcttaagaacaccagtatctaaagtgatttatgtataagcctgcccatggggtatggaaagaaaatattagagtatttcttatttatcttttatctttaaaagataaattaagctttactaatatttaacgtatggattggtggtttccttacttgcacttacaccagaggatcatgtgttatgtacagtagccaggtattctgaaggaagaatggagagttccacaataaagattggttgtagcaccatctctctgttagaatacagcattccctaggagtttatgcataccagttatatgaatttatgttgtgtgcctatataggggtgtgtgtgtgtgtttgtgagtatgtgtgtttccatcattttgttagccatgcttattccaggtgtggattgttataaggtttatgtgaggcactgttaaccttggctttatggaatttctttctttctttttttttttttttttgagactaggtttactgctgttgcccaagctggagtgcagtggcacaatcttggctcactgcaacctctgcctcccaggctcaagctatccttctgcttcacccttccaagtagctgggactacaggtgtgcagacccgtgcctgactaattgtttttgtattttttgtagagactgggtttgccatgttgcccaggctggtttcaaactcctgagctcaagtgtcttgcccgcttaggcctctcaaagtgctgagattacaggtgtgagccactgcaaccagcctgaatttctgtattctttatggttatgcttaagcacaactccacacaaaaattactttcccttttttttgaactatgcaatcacttaatttttttttatttttaatgtttatgggtacataagtgtatatagttaaggggtacacgagatattttgacacaggcatacgatgtctaataatcacatcaaggttaatggaggtatccatcacttcaagcatttatcatttctttgtgttatgaacattccatacctggccctgatttgacttttttatatgctaagagataagggtcaagtttcatttttctgcatatgattatccagctttctcagcactatttattgaggtgactatcctttccccagtgtatgttcttggcatctttgtcaaaaattagttcactctagatgtatggatttatgtctggctactctattctgttccgttggtctatgtgtctgtttttatgccagtagcatgctgttttggttactatagctttgtaatgttatttgaagtcagtaatgtgattcctccagttttgttgtttttgctcgggatggttttggctattctgggtctttcatggttccatataaattttaggattatatttcctgtttatgtgaagaatgtctttgttattttgatagggattgcaataaatttatagatttctttaaataatgtggacattttaacaatattgattcttccaatttatgaacatggaatatctttctatttatttttgtgtgtgtcctcttcagtttctctcatcaatgttttatagcattcattgtagatctcttttacttctttggttaagtttatatttaggtattttattttatgtagaggtatatcattttattttattttattttattttatgtagagatcttttacttctttggttaagtttatacttaggtattttattttattattataagtattttaagtggaattactttgtttttttcatattatttactgtttgcctgtagaaatgccactgattttttaatgtttttttttttaattctttaactttcctgaatttgaagtctttaggtttttttccaatataagattatatcaactgcaaaataaggtaatttgacttcttcaatttggatgccctttctttctcttgtctaattgctctagctaggacttcagttctatgttgaataacactagtgaaaatgggcatccttagtcttgttctagattgtagagggaagaatttcagctttccctcatttaatgtaatactagctgtgggtctgtcttacgtggcttttattatgttgatgtatgttccttctatacccagtttttttagagtttttatcatgaagggatgttaatgttgaattgtactgaatacttttccagcatcaactgaaatgattatatgattttggtgctttattctattgatacgatatgtcatattgaattgcatatgttgaaccatctgtgcattcctggaataaataccacttaggatgaatgatctttttaatatgttgttgaatttggtttgctattattttactgaggatttttgcatcagtgttcatcagggatattggcctgtaattttctttttttaagaaaattgtttatcttttctgattttggtatcagtgtgatactggccttgtagaatgagtttgaaagtacttctgtgtcccctattttttgtaatagtttaagtaggattgattttagttcttctataaatgtttagttcttctataaatgtcttttgattgcagagtttaggccatttacatcagtgaagccatcagtttctgggcttttttttttgatggaagactttattttggcattgctctccttactttttatgggtccattcaggttttggatttcttcctagtttggtcttgttggtatgtgtctaagaatttattagtttcatctaagtttttcaatttattgtcatatagttgctcattggtagcctctactgatactttgaatttctgcagtattagttgtaatatctccttattcatccctgattttatttgggccttctttttctttttttaattagtctggctaaagatttgtcagttttgtttatcttttcaataaaacaacttttcattttcatcttttgtattgttttcttgacttcaattttatttatttcccctttcatctttgttatttcttttcttctaattttgggtttgatttgctcttgcttttctagttctttgatgtgtgtcattaacctgtttatttgatgtttttctactttattgatgtaggtgcttactactattgacttctatcttagtagtgcttttgctgtatcccataggttttggtatcttgttttcccatttttatttgtttcaagaaatttaaaaatttccttcttagtttctttattgaccccactggtcatttacgagcatattgtttaatttctatgtgtttgtatagtttccaaagttattcttgttattgatttctagttttattccattgtggtcagaaaagatactttacatgattttttttttcaattttacaatactatttgtggcctaacctttggtctatccatgaaaatgatctctgtgcttaggagaagaatgtgtatttctgcagctgttggatgaaatgcagtgtaagtgtctattaggtctatttgttctgtactgcttattactttttttgttgactttctgtctggataattggtctaatgctgaaggtggggtgttgatgtctgcagctattattgtcttggggtctgtttctcactttagctttaataatatctgcctttatatctgggtatgccagtgttgggtacatatatatgtatagtttttttatcctcatgctgcattaacccctttatcattatatcctgaccttatcctttttacagactttgtcttgaaatgttttgtcattgctcctgctcttttttggtttccattggcatgtactatcttttccatcccctttatttcagtctatgtctgactctataggttaagtatgtttcttgtagacagcaaacagttgaatgttgtttcttcagtctattcagccactgtcttttgattgcagagtttaggccacttatattcaatgtgattattgataagtaagggcttattactgccattttattcattgttttctggttgttttgtggtcttctctaccatacatccttcctgtcttcttctttgtgaaagtgattttctctggtaatatattttaaatttttactttttattttttatatatctcctgtgggttattgatttgaggttatcatgaagctcgcaaataacatcttacaacccattattttaaactgatgagaacctaactctgtaaaaacaaacaaatctaataaaaactctacactttaacttcatcctttatgctttttatctttttgttgtttctatttatatcttatatactatgtgttaaaaagatgttggtattatttttgatagctttattttttagtttttctactcaagatatgagtagtgtacataccagaattacaatattataatgttctgtatttgtttctgtacttactattaacagtgaattttgtgtcttcagatgatttccaaatgctctctaacatccttttctttcagattgaataactcctttagcatttcttgtgggacaggtttgatgttgatgaaatccctctgattttgtttgtctgggaaagtattttctctttcgtatttgaaggatatttttactgaatatactgttcaaggatagaaatttttttgcttcagcactttaaatatgtcatgccactctctcctagcctgtaatgtttccacagagagtctgctgctagacttattggaacgattttatatgttatttgtttcttttctcttgttgcttttaggatcctttaaaaatccttaacctttaggagtttgattcttaaatgtcttgaggtagtcttattttgattaaagctgcttggtgttccataacctttgtgtacttgaatattgatatctttctctaggtttgggaagttctctgttattatctctttaaaaatctttgtattttgatctttctttctacctcctctaggattttccttagattttccttctctatagttcatgtatacagcatgtaatgaaatacgcatatattctagtgtgctactagtagtggctgccacttaataaataagggattgaagaatagtggcttagagttggagagacagtatttagccatggaaaatttaagaaccacttaggactggttagggtttagagtcagcagttacagagcaatattaaaagagggtttgattctaagttatgattctaagttagaaatgaaagacaaccttgggccaggcaagtgaacttgctttctaagccaactccagttccttgaaaagttaaacatagagttactatatgacccaaaaagcccatttctaggaatgtacccaagaaaagtgcaactatgtaaactatacactaaaacctatgtatgaatattcatagcattattcataatggccctaaagtagaaaccacccagatggccatttagccaactgaccatttttatttttatttaatcattcatgtttatttctccacctaaaatttgtgttcctactgtgcataaggcacttttagatgttagagctgtaatgagataaagggcagacatggttctaaccctcaggaaatttccttttttttttttttttttttttttttgttgagacagagtctcactgtgtcactcaggctggaatgcagtggtgtgatctcggctcactgcaacctctgcctcccaagtttaagcgattctcctgcctcagcctcccgagtagctgggactacaggcatgtgccaccacacatggctaatttttgtatttttagtagacacagggtttcactatgttggccaggctggtctcaaactcctgacctcaggtgatctgcctgcctcggcctcccaaagtgctgggattacaggtgtgagccactgtacccggcctcatctaaccattgatggtacacttacctatttgcagttgtgatgaaatctacaaagcagagatcgaagtcactttgggtatttagaggatttaaactaatctgagaatatcagtaaaattagtattattagtgagatattttctaattgttaagttaataatgaagttaatgtgatgggtttattgagtgatttttgtttctctttcgtgaaattttcctatcccttaggtttgtgtccttctctttttatttcatgcttccttctatatttgacaacttgacttactgtaaatgtttattttcatgtttgtatttctgtgagctactttgggggcataatccctttccgatttctttcgtaatctctagtcctagtccttaatagagggcagagtttattatgagacttcagtgtctgcttctttatgagacattttgagttgtccaggaaatgtctaatttcacaatccctccctcactgactcaatcagtttctacttattagaatatgcatattggtttttaaagtatttttaatgcatgagacacatttgatgctcaaaaatcagaaaatatggattagcagaattagaagcaaaaatttacccatatgtcactatccagatataactctgataataatttgccatatataatttcatgcatttttctgaacatctctgtatgtctatgggtatttttagaaatgagattgtactgaacatatttagtagaacctgattcttctcctcttgatatattttatgcatcttttcctcgatatatatatatatatatatatatgacacgtggtatatcattgtacatgccatgtattgtccatttactagtcctttattgatggatattttattagattgtttccaattttttactgtcatctacagtgctacagtgatcagctttagagctaaactgtagcacatatctctgattatttctttataataaatttttagaaatggggctgccggtccaaggatgtataattaccatttataaagatttctcccatatggactcctacctgtattatacgggagtgctgctttctctataagcttttctgcataggatataagttttttttatatgtgtcttcatatttgttttggaaaacattgttgaccattgtaactaaatttctgattctttcatttatgtagtaaatgtgaactgtgtgcaaatgctaacataataagcattattgatgatttggttgcagttatctgaggataaactatatgatgcattgaaataaatgtgaaaatagaaggaaatctcaaatgtttattatgaggttttgtactagaaatttacatttactttctattagtatggacttgcggagttgcaaggaggagtgctcagatatcttctagactcaagttagacatttaggcacatttctcagggattccaggctagagtatgtctgtttcagtcattatgttggagagcacttcctcagcctcgtgtgccctgtccattcatctgtggctacacttaggtttctgagggctgaaactaagaaatcactgtggagaaatgtgtactctttatttctgtgtgaagtttttgcccagttttgcctttttcacctcctggagattaggctgcacagaatcaaagggaacttccgaatgtccttttctctttcttaaagcttaaaaccagagccaacctagatggaaacagccaacatctggttgctcctctttccctctcactggactttgtcagctccagccccaaactgttttagcagccaaaagcccactacgtaattgtgaggattaaagagagtgaaggagaaatgacagcttttaaaatctctttaattctaatattaggcctgggagccttcttcaaacaatattatgggagtttcatgattgtacacttggctgtgttggatgaatcagatgccaaatgagcaccctatgtagcaaggcttgttaaactctggaaatggtgttgattaatgtagaaagtagagtgattgccatgtaagtttaattctaatgatacgtatccagcctagtgctgaaaatggatggtggtccaatgtccagttcatcactggaaaattaccctaagctaaagagttaatgtaacagaatgtaatcttaatactgatgccaagagaagacattttagtgcttacccattgccaaatactgtgccaagtctttttataaacatcttcacagtaactttgtaaggttgttattagtattacctttcatgttacagatgtggagactgagggtcacatagctacttagtggcatgggcaaagtttgacctagatttctctgattccaaaacatctgtcaagtagaaccatgctaaatgcaagcacttttggtaaatagctttattgagataaaatttatatataatacagttcagccattttaatcgtgcatttcaattgtttttccacagagttgtacaatcatcaccacaaataagtttgggacattttcatcatccccaaaaggaactctgcattccttagctactgccttcccaatccttcatctctctttacccgagccctacacaaccaataatctacttttagtttctataaatttgactgttttggacattttatgtaaatggaatcatacagtatgtggtattttgtgactggcttatttcacatagcataatgttttcaaggttcatgcacgttgtagtatgttaagtctaaattcttataatgctgctattattttctttgagaacctacaggaagctgtttagtccatctgctcagattttttttttttttttagattcatgcagtattgttttcctggtgtgtgtttatggattgtgtagttaccaccagccatatatttagttggtgtgacaagaatagttgttaattcctggattatgctttggggaaggaggggcgataatcattcttggcaataagagtacataagatatccttggaattatattaggttttccatgtagaagagttttggctttatattgtaaaataagaacagctatagtaaacttccaagtttccctgtaaaacgaaatttaagtgagtgaatagaaaaaacataaatgtcagttcttatgaaagaatgatcactttgccaaatgtctttaaaagagaagacaataattttagatgtcttgtgaaaataaagttttcatgtaaggtatagggtgaagagcaaaataaaattaattttaattatagaaaaatgattaaggatcaaattcataaactgagtatatttcatttaaagtgtgactcaagtattctatgtatatgacaggaaagtcagaaattatggggtgtaggaggtaagggaaaactttctctctgctctctgaaggtttgccgaaaatcactgacaaaaaggagattaataggtgcatacaaatttatttgatcatagttttacatggtatggaatccttcagatgaagatccagagatacaggagaaacagtctgtatgcttagcttcaagaaagtatgggcggccatgtagaaatatgactggacaaaatgggcatgatttgacgctaatagactgagtggggaaacgcagcaaggcctgtccagttaaattcttcttggtctctctaagcatgcattccctccttctgggtctgggtcaggaccctctctggaatagaggtctcatggcctacagtcaataacgtaggtcaggtagtttctttatggccagtttttacacagaaaggtggtggggagggttagagtaatatttttagattttattgctggctttggggaaaagggttctggtttccatgggattctagtttctgtggctagcctcttggaagatggaagggtcagagacaagagggtaagctaaggtcagagagagctgcttctgagatcttcattttggggtatcattttctgaaacctgtaaggggaagaaaagaaggttaaaaatcactataaaccacagggttaaccacggtgtatgtataatgagaaaggaatcatgccgtacacattcttttgcaacttgtttttttcagccagcagtttaccaggggcactatgtcatgttgataatccacttttgacatctaattgaatgaagacatggctgtactgtagtttatgaatttcctgttgtgggatacttaagttgcttctattattattattattattttaataaatcacactgtgataaatgtttttgtatctttatctttgcaagtgtctttattattgggtagatttgcatttctggtgaaatggacaattaggtttgaaaagaattgagaaaaaagaggcattacttctctgtactctcagttcataataggcaagcagtttaaacagaaggtgctttgtttttaatttggaaaaaatatataaaaaaggattttattaatggccaagccaatatacttttccagtacctccttcacttctcttgagtgaaaagagccatgaaaagctttccatatagacatctccctcctttcctagactccaggaccctctactttcttggttctcctactttgctaacatttcttcttggtgccctttgtttcctcttgtttttaaatatattttccacagcatgtggactcttttggaaatcaaccatctatcctctcctttcccccaacagttactgtctgcttcttgaaactttttctggttttttttttctgttttttaaactattgttatattatagatgtttttctggggtattctaatatagtcagtcaaccttaatgttgacttctaggaataacttaaccaacattaatagctcacttacacttgtggagtttttacatatagttttaattttgaactctttattatttgcttaggacagctttggttttgctgtactctcaagagatttgggtccaaagagttagcatctttaatttgcagtgaaaaaaatcattaacgtcatggtttacaaactcgtgtacatggggtatttgaagactttctaagggataggcagccatgttagttttagtaactacatgtccagatcttcaacttcactatgtactcttccctgacatttatctgccttagattaaactgtttctcctttcccagctatcctttcataattgcctcctttctactctgcaaaaagaaggcctatctctacttgtaaatctttcttagttcattgctctcaggtataaaaatttcagggcattgaacaaagagacagttcaaaatattgatttttggggaagcattttttatcaaggaaccatcttgctcttctactgagaccacaccatttctgattttttaaaccttttatgtttggtgattactttccaatatttgtaatatttatgttttgattaattgtatattagcaataatcataacaatgatgcaactcaaaatttaaaaaaactcttagtcttatggtcataagaaataaaaataattttaatttataaagttatttttgttatagaggcatatgagaggtgaccaatagcagactctgaaccattaaatatattagaataaaattatgaagcataactgtaatagaaatacaatttctttttcaaaaacattgtattattttatttttatttttttatttttatagatttaggaggtacaagtgcaggattgtcacatgacagaaatacactgtcgaggaagaaaatctatacaattttggagtgttagaggcattttttatgtggattttatgaaatggatgatggtagatataaattgctatggcattttatctaattgtataaacttagtagaatgttatagcaattttattttaaaatggaagtatttaccatatgttagaaaataaatcttttgcagtctttatacttcttaaatgccaatttacatgatttttcaaaactttttaggagttgcatgagcaaaaagtatttaaagactcctaccttcagttatgctttaaacttgattttcttttatcatatatgatttaattggcacaatttaaattggtataattggaaattaaaaagacacaacagagcatctggtacataattgctctttaatattatttcctccaggaactcctttctgatctctgctctcttccttaaccaggtaatttccccctctatatctagtatgaaacttctgcagtttctcttaacacaaggttttgtaatgcatgtttatgtatcagtctctactacctgatgctaaggtcctcgaagatagaaagtatgttttagcaactgacctcctcctgcaaagcgtccagcttagtacctggtacatagcagttgctcagttcacatttcttgaactgaacaataaagaagataaataattagtcttatgaaaatattagataaccttaagttggtttaagtgtcagggtttgtcttgtctatctctagtgaaaacttattcctttgcatattttgtaggaataatttcaaaagttaccaccttcaaataaagttgaaaaccatgaaagagttttggttttttttttttcgtggggtgggggggtgttattatttagatccattggtatattaaaatttttttccatctagcgtctttatctgtaaagaaagggattagaaaatatgatgtccctgtttctaaaaccagatatctgcataaatgttctgacttttatcttcatgcctcttttaagtggaagagcagtgcggaaggttaaactttggaattcattgtgaatttgactgctttatggcagcaacacatcagaattcctgatattggaacaattcaagtcaaatccagggcttattgctgtcacatttctaatttcctacccgttttgaaattttaaagtaaattcactaataaagtctaatatctggtaactgaaagtatggttttataactagcagcttctgtgtcacctggcagcttgaaacgagaatctcaggctctactctagacctactgagttagaatctgtagtgtgatgagatcctttcaccacagggtattcaagtgtacattaaagttaaagaagcattggtctaatctaattgctaagctgtatccagttaataatcacatagtctagttcaggagttggcaaaccatggctgactcttccaatccagcccactacctttttttgtaagtaaagttttattggagcacaaccatgctcatttgtttatgtattgtccatggctgctttcttgctacagtggtagaactgagtagttgtaatagtgaccatgtggcccttgaaacctaaaatattaattctctggcccttgacagaaaatgtgccctgccctgtcctagctggtgataggtcagttaccaccatgtatttataaatttgttttgagatgagtgcttttttatgccaagcactgtgctagatgctgcttttgtttgggtggaaaaatcttgtttatccttgtttaaaccttgctttgggggaaccatttttgttgtgaatcactagctttctagcactgaagagcaaagtaattcctaagaagttttactaaaaagtttcctttttctttgttgaacttgtagattataggttttgtctttagtcttgattttcctaagaaggaacttgtttgtttctatgaaaagggaccacaggcatgtttgttccttgttattagggagttgtagttagttgtgtgagccactcaggcttaaaagactgattttccctattgtttatccatgaagaattcatcagttctgttatccccagatctgtggatacatagggtgggggtgggaggatagaagaatcattttcattgaacgtgtaatcaggttatgtttcaggaactctcaacattggttacttagaaatgcattcgtggaattctatctttgtaaagtggactaaactcaagaggtattcctaaaaactttatctttgaagtttaaagtttttctctaaagtggtcttagtgtttctgaattgactgcctaattcatcaatttttttgatacacagcatattgattcttaaatatgaaatgacagtaaactgtatttctcagtctctttctacagtacacttacagcctctttagccctttttaacatttagatggatgatatttttattctttttgctagtaaatactcaatttgctttacttttaattttgtatctgttgaacaacttcccagtagttcgatttattgagttttaagctatgttgatttaatttctgttattttcctttattatcttggagtctaacctctattagaaaagaggaaggagtgaccattagaaaaaaatttcctctgattattgtgggggaataaagcactaatcattttcttgtcaaggaattttttgacatattcttcctatgaatttgctagttcatcctggaagaatgtccaccaaaaaatagataactcatacagacagaatctagcaaaactgaaaagtgaatgtccctatagggagttctttgtgtcattctttctgttcctgcagagaaatcaatggaatttgcattggaagatactgttccttgtggaagtatcctaggcacctgtaatttctcactagggggaataaaaaagaaacctaacgtctctggctgttgagtagtgagtctcttgggtggcttcatagtctagatcaatctgtttaataaatgtctctgtttttacttgtgtcacacaattctaaacctgttctattcagatattagaattataagtatgtactacaaagtgccaaatagtttttcagaaatacagaataatttaaaaagtctctgttacacctcttttggaaatgtcatggtgatgttacgggttgttaatatgagagtagctttactacaagtccaaatatttttgattctctaaggcatagtttgggatttagatatgttcatctatattctttgccatgaacaggacaaaagttgttcaactatgttagaaaatcatcagaattactgtcatttagattataagtgagttttaaaaaggtacctcaatatctatatctgtttgtttcttttttccctacaatgctgccttgataataaactagtctcagacattaaaaggctgtgaaattgcttaaataaacctgtgctagtcattttttaaaatacttaacaacccctaaccctatattattaggataagaaagaatgttatttttctcattgtttctgctccattgattgtgtctcttcaaaatctctcttatcccgttattgtgttttggtaacagaagcatcctgttttatgaattgtgtgtgctgaattagcttaagagggcttcactgcgtgatgatgacttgagtcctttaattgtgaaggcagtttcttttgccttcattatgaaaagggcaaataaggcagttttcatagcctaaaggttttttataaagctttcctctgttggagtaaagaatcaggacaaaaggagtaggctgttctcaggaatttctagaaatagcttttgaaagtaaaattaggagatagctctctgttcctctgcaaaagaacaaagtcatttttacagcacaggaattagaaggaaaggctctgattcttctgaggttcactatttttttttctgttggttataacaacaataactatatttttcagtgtataaagtaggtgtacagttgtctccatatgggctttactggtaaccttgtgctgtacatagagcaggtgttactagtattatttccattttgcagctggggaaagagtttgagggaaattaatgacttcaccatagtcacacagctaccaaatcagagacctggatttctgactttaaaacgtgctcttcccagcctaccacactgcataaggtcttctttaatctgtactgtttagtgttggtaagattcttgtggaagaataacatgggaaattggtaagattcttgcggaagaatgacatgggaaaagtatcattctcccccagcaacaaagtatgcataacataaacacttaggctgagatgaattcttcagtatcttatagacagactaagcagaacattctgagtcattcgtacataaatattcgtatgctatatgtggatgatttctaggtattatccctcatgattgattgattgattacatgttttgcccctactattcaatggtagatttagcattgtaggctggcagtttccttagcactttttaaattcctaatctaaaaaccactgcatacccattgatttgcatttttaataattcaactaattttcacagaattaaattaatatttattttaagttaaacttgaatgtgctttacaaagaatggcaatagacagctttttttaatttaaaaggaaaaaatgttatatctggaagaatgcaagcattaaaccataaaaactatagtctaacaaatttaattgagttatatggtaaaaattctcataggaaaagttatttcatcattataattttacatttatttattaaaactttcccatgtataagaaatagtggtttaaaatggtgatacatgggtaaataaaatgtatatattccttttccttatttttctaacattaaatatgaataatagttattaaataaatatgtcaaggaactagcagaagagatgagactggaggaatagatggaaggcagatcatgaaaaaccttgaaagccatgttaagtgttttttccttgtctctgaataagtaaattgttttttaatttttatcattttcaatatttaaaattaaaaaaatttagttatgagtacataatagttgtatatatttatgggatacatgtgatgttttgatatagtcaaactgtgtaatgatcaaatcaggataactggggtatccatcacctcaagcattatcatttatctgtgtttgaaacatttcaattatagtctcttagttatttgaaaatataaaataaattattgttaactgttgtcactctattctatcaaatgctagcccttattctcactgtatttttgtacccattaatcatttctgctgtattccccagctccttgccaccctttgcagcctctgttaaccatcattttacccctatattcttttttttttttttttttaacacttccacatatgagaacatgaaacatttgtctttcttttcctggtttatttcacttaccataatgtcctccagttccatctatgttgttgcaaatgataggatttcattcttttttatggttaaataatattccattgtgtgtctataccacattttctttattcattcatctgttgatggacacttaggttgcttccaaatcttggctattgtgaatagtgctgcagtaaacatgggaatgcagatatctctttgatgtactgatttcctttcttttggatatatttatatattcagcagtgggactgctggatcatatggcagttctatttttaatttttttgagaaaactccatagtcttctccatagtggctgtactaatttacattcctaccaacagtgtacgagggttcccctttctccacattctcaccagcattcattattgcccgtcatttggataaaaagcattttaactgtggtgagataatatctcattgtagttttaatttgcatttctctgatgacgttgagcatttttcatgtacctgctaaccattcatgtcttctattgataaatatctattcagatgttttgcccattttttgagtggattgttagattatttcttattgagttgtttgagctccatttttattctagttattaattccttgtcaaatttatagtttgcaaatattttctcttattctgtgggttgtctcctcgctttgttgattgtttcctttgctgtgcagagctttttagtttgatgtgtgatcctgtttgtccatttttgctttgattgtctgtactttggaggtattactcaagaaatctttgtccagacttatgtcctagaatgtttccccaatgttttcttatagtagtttcatcctttcaggtgttagatttaagtctttaatccattttgatttgatttttatgtatggtgagagataggggtcaagtttcattcttctgcatatggttatccagttttcccagacccatttattgaagactgtcctttcccagtgtatgttcttggcacctttgtcaaaaatgagttcactgcagatatgtggatttatttctgcattctctattctgttctattggtctatgtgtctgtttttatgccaataccatgctgttttggttactatagctctagtagtataacttgaaatcagataatgtgattcctgcaattttgttgtttttactcaggatggttttccttatactgggtctttatgtttctgtataaattttagcattatgttttctgtttctgtgaagaatgtaattgttattttgatagggattgcattgaatctatagattgctttaagtaatgtggacattttaacaatattgattcttccaatttatgaacatggaatatctttcaatttgttttttctgtgtgtcctcttcattttccttcatcaatgtttcatagttttcattgtagagatctctcatttctttggttaagtttattcctatgtattttattttatgtgtagatattgtaaatggaattcctttcttggtttctttttcagattgtccattgttggcatatagaaatgctactgatttttgaatgttaattttgtattctgtgactttcctgagtttaatggtcctaattttgttttggtagagtctctaggtttttctaaatatgagatcatatcatttggaaagaaaaataattttacttatttttttcctattgggatgccctttctttcttttgcttgattgctgtagctaggattttctgtattatgttgaataatggtgaatgtgggtattcttgtcttgttccatatcttaatggaaaaactttcagttttccccattcagtattctactagctgttgatctgtcttatatggcttttattgtgttaaggtatgttctttctatacccagtttttttttttttgagtttttttttttatcatgaagtgatgttgaattttattgagttctttttcagcatcagttgaaatgatcatatggtctttgtccttcattctgatataacatattgcattgattgatttgcatatgttgaaccatccttgcatccctgggatgaatcctacttgatcacgagaaacaatctttttaatgtattgttgaatttgttgtggtggcattttgttgacgtttcacatctatgtttgtcagagatattggcctgtagttctcttttttttgttatatctttgtctggttttggtatcagggtgataatggcctcatagaatgaatttggaagtatttcctcctcttctattttttggaataatttgagtaggatcgatattagttcttctttaaatgtttggtagaaatcagcaatgaagccatcagattattggcttttattgatgggaaactttgttatggctgcaatctcactactttttattggccgattaaggctttggatttctttttttcattaaatcttggtaggccatatgtgtctaagaatttatctgtttcttctgggttttccaatttattgtcgatagttgctcataatcttctctaatgatcctttgaatttttgtggtattgtattttgtgaatgttttttgtaatgtcccctttttcatctctgattttatttatttgaatgttctctctttttttcttagtctggccaaaggtttgttgattttactcatcttttcaagaaaccaacttttcatttcattaatctttttgttgcttttcagtgttcgtttatttctgctctgatctttatttcttttgttctactaattttgggtttgatttgctcttttctagttatttaagatgtattgttaggtggtttgtttgaagtttttctactttattgatgtaagcactttattggtatcaactttcctcttagtactgcttttgctgtatcccatatgttttggtatgtttgtgttcttcatttgtttcaaggaatttttcactttgctttttaatttcttcattgactggtctttcaggagcatgttgtttaatttccatatgtttgtatagtttccaaaattcttcctgttactgatttctagttttattccattgtggtcaggaaagatacttgatatgatttccatttttataaatttttttagacttgttttgtggtctatcatatagtctgtccttgagaatatttcatttgctcctcagcacttttaagatcttattgtatggtctctttgtcttaattttaaaaatgttggctgggcatggtggctcatgcctgtaatcccagcacttcgggaggccgacgtgggtgggtcacctgaggtcaggagtttgagatgagtctgactaacatggtgaaaccccgtctctactaaatccaaattaaaaaaacattatctgggtgtggtggtgcatgcctgtaattccagctacttgggaggctgaggcaggagaattgcttgaacctgggaggtggaggttgcagtgagccaagattgcaccactgaattccagtcaggcaacaagagtgaaactccatctcaaaaaaaaaaaaaagaaagaaagaaaatattattctcaattgttcctttgcaggtagtctgtattttttccctttaactttgaagattgttgttttgtctttggtgtttaatggtcatattataatgtatttagatataagcttatttgtattacaagttaagttagagaattaatgtcttttattaattttggaaattcttagccattacttttttgactagtgtttttttttctattctttaaaaaaatttattttgaaattatttaaacttatggaaaagtttaaagcatatatatatagaatggagtattatatatataatatatatattatatatatatataaaaagaagtgagcactaacacatactacaacatcgatgaaccttggaaaaggtacgataactgatagaagctagacaccaaagagcacatgttatattattctatttataggaaatgcctggaataggcaaatttatagagacagaaagtagatttgtggttgcctagatttgaggagcttaggggacaatcaagaatgatgaatgattatgagtttttttgggaggaggtgataaaaatgttccaaacttgaatgtgatggttgtgtggctttgtaagtataccaaaaaccagtgaattgtacactttacatgaggaattgtatggtagttgaattatatatcaaaagagctgttgttaaaagagaaaatagatcattatttcgtgttttttcacccttcttcccctaatattaacatcttgcttatataactataatacagttattgaaactaggaaattaatattggtgcagtgctgttaactgaattatggacatgtgtgtttaaaaatgtcctttttctgttccaggatcccatattgcatttcgttgtcacgtttctgtattagcccattttcatactgctgataaaaacatacccaagactgcgcaatttacaaaagaaagaggtttaattggacttacagttccatgtggctggggaagccttacagtcatggccttttcttctgccctaggagactttaattgtttgagaatagtgcaaagctctcttattagttcctcagtctcttggcctttgtccctgttatgcactgttttctttgtttgttttgttttgtttttgttgttgtttttgagacagagtctcactctgtagcccaggctcgagtgcagaggcgctgtcccagcccactgcaacctccgcctcctggtttcaagcgatttttgtgcgtggctggggcatatgcctccacgcctggctaatttttatacttttagtagagacagggtttcactgtgttggccaggctggtctcgaactcctgaccttaagtgatccacccacctcggcctcccaaagtgctgggattacaggcgtgagccaccacgccaggcccaaatgaatcttttaagaatagcttttaaattgttttgtatttcttaacttgaaatctctaaagcctaccttttcttttagatttggttccaactgctttgatattctaagtatgctgtgatctaccagcctttccccaccaatacttgtgctttttgtacctataacatgttgttttttgtttgacttttgctttccattttcttgtggcatggctgtgtgatttctgttcattctttcttcaaatctcttctcaggtcttatcatctcttgataccttccctgatgactcctacccattgacttattatcctccatagattcctcttgaaactattttctgttgaaatagtttaaagtcatatcatatacctttttgtttccaataatttagagtgatgtatctttttcttcctttacaataaggtgtcaagtttttgaaggattagatcatctttatattttgttgtttctgtgagtattatgtaccactctgggtatgcagttgtgctgaattgatagcttttagagaattggtttgggttttatttcaaatgctgatgatttataatatcagagttacttctttgtgtaaatgtgcctactgtcatgcctggtctacaatactgcccttaggaaaggttagttgaacccaaatcatgtaggggatcccaaatcaaagagcatttattattctactgtttcacaggaagtataaagtaagagcaaatgcactgaatccaagttttctcagaaatactctgtctactgtctttcctttgagcctcttcttaatctgtctccttaagtatatattactcatttatctttgacatttttcatttactaccttatgtagtttttctaaataatttatatttgtaggtagagataaattgtatgtgttaattacagcttaaaagaagagattggaatattttagaaagattaattcttattaaagactatctaattgatctgtgtttgcattcttcctatctgagtcttaacattttcataaaacatctatcagtgaaaaaatcatcagtgttagctggaattgaacttaagaagatatttgactacccataaaaccagatattgaatgaagaacacttggtttaagaaaattgggtcaagttagaaatgatacaacatttttgctgggctttagatttattttatcattaatgacctcttaaaaaaccggaattaacttttaagacatcttaaattattatgttaaatactgtagttattctcctacctctgaaaagcttgtaaggtgatttgagaatgtttgatttatatatattaatactccaattttctgagtggtgatattgtttcaacagggctgaaaaactaaaaaatgtggatacctggctttagaaatgggctagcattatcttacctgctttgtttcaggggctgattcttcaacaatgcatatagctagataatctggagttaattttgtgtgtgtcggtgggagtgagagcttgtgtgcttaggagagagttatttacttggttaactaaaaacgaagtagtaaaaaagcaattgtgtgaggcaggcataacttcaacagtttacactggtttaagttatttcatttgaggggtggtaccttattaagtcctatcttctaggcatagtcttatttgtttcttaagtttccttataataaaatatagtactcttaattaatggcttcatataggttggagtcttgttaggtgttgaccttttctatttgcttcacaggttgtttgcattcgctccacttggaatgctctctctccaaagctgagttgtgacacaagacctctcattctgaagacactgagtgaactattttctctagttccttccttaacggtcaatacaactgaatatgaggtatgcatttggagctcagcacattgcctgcttcttcatgggaaagatgtgtgttataataacttttggaataaatattcctaatctgttgttgttgttgttgttgttctgagaccatgttgatatgtttatggactcttaggagtaagatagctcctcatcaatcttatgtctaaaatgtatttacataaaggataccaacttttaattatgagagtattgtcaagattttaaagtcaatattgtaaaactagtgtttccaaaataatagaattcataaagccaaccattaaaaatcattttgttaatgttttaagttctaaaaaataagccacaaagacattaataaaggcaggacagactctccaaactttgtgaattactcagtgtttgtcattgtaatgagttgaaatacttggtggaagattcttttttgtaagattcatatattactgcttaatattttcttaattatctcttctttgagtgaaatgcatgagagggtagtgaattacatttatgcctctacatttgtaagccatactttttttttttcatgcttaccatttttccttttccttcaaagagcagcagttgattttcacttgcagtcttggtaaacttctagtttgatttagtccttcacagactttgataaactgccactccagccatcagattccaataatagtcctttatatgttttagatcatctgactgagacaggcttagaagatacttcaactcattctaaatgctgcacaatgaataaaatcaaatttatccttactgggctatacaatacctatcacagtacctggtgcataatctatatgtagtaagtagttgttgaatgaatgattgaatcgatacagaatattttagtttattcttacatgtagcctttttttagggtcttaaaaaaagaatcaatttgtgactgtgagtatacagttcaccaacattctttcttatggctgcagttcacaggcacttgctcttatattgtcagagagtccacagggctactgataatgagctaagactaaaagccaatgtaaggccatattgggtatatttactttctgtcttcagaggctaaaatcatatatcttttgtattgcttgtaccttgagttaatcagattttattacaggttaatttatgaattggctggtgtgttggttttttgtgttggcttatccatggttgtgaattatcttttggaccagatttttttttcttccagattttacattcttttcctttggtatcttatactagggttcctctgttgttcagacggactgctttggggccgttctctctatctcttcctgcccagttagggggagtctcttcagtgaacatagtccccttaaaagcagaagtgaagaaatgtagaagggagagaccctccttcctcctcccactttcatctgtgtgtgtttagataattggttttttaactacttagaatttgtctggatgtgagccaaagttgaatttaatttttcccagagtgcttcttaagtcatttctatccctagtaacttcattagcttaagtttccctaaaatgtagtccaacctgtttacaacaagtccataaagcattctggaatctggcctcattagtggtctgtatgctgcactccaataaaaccaaaccacttacagtgtccttcaaacttttccttcctccaaacttttccatttcttttcctttgttcatattattccctctatctaaaattactttctttttcctctttaatttaaaaatatattttaggaagaaaaggattgttttaactcatcccatcctttgagagtttgtctgcaagctggagtcttttgttcccaaagttctttatactgttctaagaacgtttattctattttatactacaggtatatgtatgcatatattattttccccattcaactataggcttattgaaaatggagtccatgatttaattatagtgtattttctgaattgctttgcacagtgcttgcttcacttattcattgaatcagaatatatttattaaaactgcgctaggtcttagagatactaataaatatagtcaaccctatttttgagtacctattcaatccccatcactcttactagtttataccaattagttctaatctctgataggaaggtatcattttttattgtattgttacagaaactaaacctttgagaggcctatttatttgacaaatatttatgagtatctgctatgttctaggcaagtaacttgaccaagactgtagttaaaaagctaagtgaaagctgatgtctgaatccaggactttctagtttcatatcctttgttttcgcattataccatgttatcagtccctgccttctagaagctcaaaggtaggtaaaggagatagatgtgagtgatgataattatagtaacatttgatgagcacagttaattaaagggcaatgagagtgtggtagagaaaatgacaaacactcttagcaagaatccaaggaaattatttgtgctattggacttggaactggaagaattaatatactgttgcttcccattgaagtttggggactagaatatgcaaaggcaaggaggtatagaggaacctaatatgatttagaggggcaaaaagttagatgtggtggcaatgaagaagaccaccgactgttggaaggtaaatggcttttatgcttaatcaattatttattacacatttgtcatctttgaggaactgtgtgggctctgtggtttaggtctttgaaatgaaaaaaacgcagtcactgccttaagtattgtacaacctcgagtgagttagtcatgctagatgtggaggtgtaccatgtgccgtatggccacatggagaaaggaaaactctcttctgggtaggctagaacagtggcatgaaagagtgacatttctgttagtacttgaagggactaagagtaagaaatggttaggtttctaaatttcattatcttaaaatcttaatgtgtttaaaatatccatgtgcttagaggatgagtttgtttctgaatatttacattttatgaatgatgggtgaatacacattaagtgaatttctggtggtgttactttaaaagtgacttaattttcattatttgctactttggattatttagtctcagttttagcttggtcttaacaatttattcttttgtatgttaacttttcagaattttaaagttcaagtcctcagcttcctctggactcatactcaaaacaaggtactatcacaaggcttgtcagtgaatcagaacaaagctaaggaaataattttgacatttgtaaaataagactcttaggataaaaagtacaactgccttgaaataatgggttcccaatttttaaaaaaagtgtgattattcataagttttggttttaaaaattatgctcaatttatgcccattaatacatttttaccataaagtgcacttaatacttggtgaatctgacagatgggaagaggaactgttgatattatcttatatttttatatggtctttcccctttcctgctttgccccttccccaccaacaagcataccaaacaaacaaaaagtccagtccattttttagatgttgtttccaatcaaggattatatatagagactgctggtgatgttatacctaactcatggatgaatgagcttagattccaaaaaggctaacttgccctattaataggtggagaatcggaatccaaacctaggcctatcagacagtaactccttgttctccttctgctaaatcatactacttcatggagacttgagcaattatgagttactttatatttaatgttcaaactaggataaaaatttagtatttttgatctccttgcccatttttaattgggcatattctccagaaaaatgtttaatgctgataattttttccagttgttcttacttcccttcacagaccctttcacttttttttgcaatattttgttttgaaacgaggattaaatttctcgatctctcttttgaaattgctagtaaatatccttttagctaggcaaagctttaataccattttcaaagcactgactgtagaactttgggattggtgagggaaggtttctttccccctccagatttgatgtttaatgcatgttgtgtttttttgtttgcttgctttttttttttttttttttttttttttttaccctatctaggacccaattgtagcaaatgctgcatatagatccctggccaactttactgcaggagaacacaccattcttcatctgcctgaaaaggtaggcatatctgctttctcactggtatttcttaatttgctagggtttacaactttttctctctcatcttaggagatacttacctgatgaatatatacataaccctagatctgttgtccatgcaagatacaaattcatacccattatttgtttatatgtaaaagactgtagaggtttgaagcagatggaagacacctatgatgcaaatgaaatcttcttaaggtgactgggtatatggcttgctccagatctgagtcactcatagggatcactttgcctaattagtatgccatcctggactttaatccaagcatggccttcatagactaagattttatagcacctgtgcagccaaagatctctatttgtgataaacaatgggatgccatatgaaaaaatctgcttttttttagtatctgtgaatggtatataggtagctccagaaaactggatggagaaagtatcactatcttttaagagttaacacatagtgtgatattcagttaggaaaagaggaagtcaaattgtccctgtttgcagatgacatgattgtatattatcttagtttttagactaaactaaaaacatataacctcttctagtatctgcctattataatcagctttaaattagtagatcctattaaggggttaaatatctgatttcttatttagtgccactatgaattcaaatgcatacagatgtttattgagtgcctctgaagtgtcaagcagacattgtgttagatgaagttacgtgtaacattactcagaatctgtctttgaagttacgtggcaagaaggtttggtgtgaattccttgggatcctcaggcattaaaatgggtttgcctttttcttctggattgcgtttatactgagattagatgccagtaggaaccaggcaaatttctgtttactgaattgaattggagccacgatataaaaaggattgaaaataggctgttgtaaaaccaattcctaaggcaggcaggatttcctgtgtcattgaggacttacaaagatagattgaccgcttgtcatgcagtgatcacaaatgggaaaacttaggtaaagatgtgttatgactcatacaattaaaaaagatgggacttcagactgcattatgatgaccagcaatacccattgttgctttaaaacaggaaagaaaaaggaaaaaagctacatgtaaatttcatatgcaaacacctgccaatagattagctacagcatctggagaggcaccttttattcttgtttttaataggcaattattcatttaaatcacagcataaaaattacccttatttttacctttcattcctaaaatattccagcttgagtaatagcttttattaaataactccagcatactcttgacatttagtctctactttttaaaatattgacatgcttatattttttttctgattttggatttatattcaatttccaattatgtttgcaagaatttataagtgctatactcagccaagtgttagctacttccttaatctaactcttctaaactctttgatccctgaatagccataaatagctctttatatcttccaacataaatggtaaacgtacttagagttggggttttctatatatgtttgggttttcagcatcagagtggaaagagctataaaggaaagctataaggcgtatccttttgtagctatgcttttcagctttttttttttcttgccctaatccccttctgggatatgacccattccaaaaagtaacaatagctcactgcagtggatattctgaactgaggttgagatgaggggtgtaagtggtttgaaagagtcttcctcactctgaccccagcttctgatactgaggacctatctctttatggagaatcattgcttctaagaccacaccatgcattcttcttcttttcattgattgctacatttcagtttggctgttcgaacacctaaagactaaaagtccagaaagtgttcaatgtgttcatatcccaaacaagttcccaaacatacagcctggtcggtgcttcaccttagttttgtagatgtgacactataaaacagtgatgtgaaactgcagctcatttttctataaaaatgtattttcaaatgttttggaagttcctgtcaagtgagacttctgtaatgtaaaaactaagattcttctttgttgacagacattactctgcactaagggcaattggtttacacacaagacttaaggttacctatttttccagtgaaagtgtgtccatattctctcttcttacctatggaaaccggtggaataaacttttgagcccattgtgaatttcaagtagagctaaaaaatatatatatataagatatccttacaaatgtggctactttgtgaattataattcagctactttttaaagtactgattttctttaaatttacttaaatatttcttgttgattgctgaacatcaatttatgttgtataacttgttgaaagttaacagactggtagaacaaaaagagtaagaggattggcagatatcagaacaaagatttagggttgaatgaaacagtacatttaaggtaatgtactggatagatggtagagctgaatgagatacaataatatgagttaagaatttgaataccatgttgatgaattcatctttcttgtcatttgttattaagaatttctgtgggattagaggtgatggacatgtaatacttgcattggtttaataataatttatttggtatatactaagtgctaggtccgatctgaagagctgaggatgttgactgaatgcatatattttgttggtttgtaacaggatcattgttaatcacttaaagcacacagatctaaaattggttccaaaatttcaggggacttctttgaggacatgttgattgtcatgttgaaagatagataagaatgatttttcccttttagcttttattttttctgattttataaaagctagttacacttcccctgtcttctttagcacacctccccaaaagaaaaaacaaacaaaaaaactatggagaagtttccttgttaaaagaatcagtaatggataaacatttaggtagaagatactgacttttctctctgacttggtttcattaaaaaacattcacctatttaaaaattaaacttgttttcttgatttctagggttaattttagaaataatataaaagaactgattatgcattcagggttggtataaatatggtgtaacccgtttggctttgatttaaagtgaatgtcactgcattcatcagaagctgtttctctttttaactgaataatttatgcagatacttgacatgttccaaataaaattctctgtttatgcacaaactcttggatttccataggttacagacacagaaagttgattgaaaggttatccggctcagaacccacagtgaggcattttgtgggatacactttccagtacagatggtccccaactacgatggttggacttaacgatttttcaactttatgatggtgcaaaagtgatacatattaggtagaaatggtacttcgaattttgaattttgatcttttctcaggctaggctaagatatgtggtaaaccactctcttgtgatgctaggcaacagcatcagatcgcagctcccaatcacactgaatcacaagggtaaacaactgatattctatagtgttctgtgttaccagatgtttctgcccatctgtaggctaatgtaagtgttctgagcacacttaaggtatgttaggctaagctatgatgtttgataggttaagtgtgttaaatgtatttttgtcttctgacattttcaacctacgatgggtttattgggacataacccccatcatgaatcaaggagtatctatattcaatttgaagcaagttttaaaagtaaattatcagctgagtgtggtggcttacacctgtaatcccagcactttgggaggccaaggcaggcagatcactagaggtcaggagtttgagaccagcctggccagcaaggtgaaaccccctctcaactaaaaatacaagaactagccgggagtggtggtgcggggcctgtaatcccagctactcgggaggctgaggtaggagaattgcttgaaccctggaggtggaggttgcagtgagctgagagcatgccactacactccagcccaggcaacagagcaagactctgtctcaaaaaaaaaacaaagtaaattatcatttttgactttccatttaagttttttaacaaagcttagttataataggcaggtcgtttttgttggtggggtgtgtgtgtgttttagtaggttggcacaaaagtaattgcagtttttttcttttgcgccaacctaatagatacatatgcagttttatttttctgagtgttttagcagctaatataatattattgccaaaattttataaccttaacaggaattctttcaactgagttctcttgattctctatagttttactcgcattgaccttattaaattgttgcacacaaccagggggaaagactggtagtagcctagggaaggtagaacaaataattcttttaagaagtgaccagaggagtaaagaacttactcatgtaaccaaacaccacctgttcccaaataacctatggaaataaaaaatttaaaaaaaaaaaccaaacaccgcatgttctcactcataggtgggaattgaacaatgagaacacgtggacacaggaaggagaacatcacactctggggactgttgtggggtggggggtggggggaggggtagcattaggagatatacctaatgctaaatgacgagttaatgggtgcagcacaccagcatggcacatgtatacatatgtaactaacctgcacattgtgcacatgtaccctaaaacttaaagtataataataataataaaataaaaaaaattaaaaaaaaaagaagtgatcagaggagaaaggaaatttaatggaaccaaaatgtaataaataataagtgctaatttgtccaggagaatcagctcacctattagaaaacaaaattgaaggagtgatcataccattataaatacatatagtatataatctattcttaaattataatacatttgtaatttctttgctaaaatttatgcacatttgagatgcagacatatgctattcactgcatagaagataaattaatatagcacacagttacgtgaatatgaaattagacaatttaagattgatgggttggtcagtttgctttatccgcaatctttctttagtggctcttaaaaatattgatgacccaggtgcagtgacttgtattaagtaattaggttgactgcacagaaggacaggataggaggataggataaaagttgtacagaaatgatcatatcccttttatactaaataattctggaagcatttggtcatttgacatagtttgcacagcactttaaggttcctctggtggtggcagtgacttttccccgactccccacccccccttactcttttcattctactcccctcctcttcccctccccctcctcctcttctgcatgcctacataccttcctccctccctctctccctccatagctccttccttccttcctttcttttctcttttcttttctttcttgcttgcttgcttgctttattgacatatgattcatatactgtacaacttaccctttaaagtatgcaatttagtggttttagtatattgaaacaattgtgcaactaatcacagagcaaccacaatctaattttagaacattttcccccctgaaagaaactctctcagcagtcagtctccattactccattccctctccaagacctaagcaaccactaatctgctttctgcctctgtaagtttgcttattctggacctttcctataaatggaagcatacaggatgtggtcttttgtgatgggctttcttcacttatcttagtgttttcaagattctttcatgtgtagcatgtatttgtactttattcctttttatggctggataatatttcatggtatggatttatactatattttgtttatatattccatcaattgatgaacgtttgggctgcatgaatgttttgaggctattataaataataattctatgaacatttgtatgcaagcttttgcatgatcatatattttcatttctcttggttatatacctaggagtgaaactcctaggccatgtagtaactctatttttttgttttgccacgttactatgatgtgtaaaatgtcaggaagcaaggcagaagaactcagaaccaacttctttctcaggactttttaggccactaggattgtttagaatctttaagacaactctcaaggagagtaaacctggaagactgtgagtatgcacacagactagacacttgaaaaaccctcctggtcagaatcaaaaggtttgcgaacatgccagagtttctctgatatgcagtgatttcgacagacgctttcataccctatctagagtatacctgatagttatctctgtaagtatggctgattccgccctctgagaattaggtacttaatactgaatctgaattaaatcttgtcttggacagtgctcgggtagtcaggttgctttcacttctccttcactagtgaagagaacactagttatggttgaaaggcttcattggagttgacattattattcttaagagaagcatttcttttctgtttcttctacccccctgcaagaatcctgagtcagtgcacttcctaaatggaacagtgctttggggacctatgaagaaggcagtctgcaggaattgttaattatttctaaaaataactctgggatacaggctaatggtgatgactggattctggcactttatggttatagaaaccacttttatatattttgatttcctcccctaatgcttaattatctccatgtggacattatgatagagtgtcattgaaggtattaaaaatgtaattaattgcttaacagttatatcttgtgaaaacaatgtggaaatctttttacatttttaatttttggttcaaacaaacctaactaatcaaagagcagccacaaaaatcctcaaaatgcaaattagacacaataatgtacagctaccaattacagattttagtgtttttgtattccacagcaacaaactgccaagtcttaaaaaaaaagaagtcaactaaagcattctgttgttccctgagctctactgtatattctactggaagattttaagctctgtcatggacatatgactagaatcacaaattttttaaaaagtgttcagacaaggcaaatatctaactatgagctatagaagttaaatatattgagtatgtcagtgtttgcattttatttttggatggtatagaattttattagttttctataataatcattgcttatactggcttacagtgatttactgtattaacataagctttttatacagatctgagattgtatctaataagatgactagagtcatgaccatttagttaatctaaaaaatgaatagatttttaaaaaattaatttcagtggtcttttatgttatagagtgatggagtctaacaaaattttaaaatcttgtcacaaaaaaggatacagaaaagattttgcataatgttttattattatcctctctatgatcttttcgcttatcatttcagataagaccagaaattcccattcctgaagagttagatgacgatgaagatgttgaggatgtggatctttcagttcctggctcttgctatctcaaactgttgtcactcactccccctttggttttaccaggtgactcctatttggtagtagagaagctagcattttttagtggttcgatttgtctgattgtattcttttgtgataggtacatagtatagtttaaccttatgtgcttattttttaaccagaatgttaaatgcacccatctgttctattgaaacagcttgaggtagtatggtgtttaaatcatacgaaaaaacgttacatctgagtaggattgaacaagaaaactagtgtaaacaattgtgttcactgataattaaaattcatttaaaaggctaaatgtattccacaagatgaatttgcactggtactctaggtcattgatttaaacaatacttctttcttacataagccaagtgaaaagatcattagactattcagagatttactgagtagtttcattattatacatttattctttctatagagttatgccaaagatgttactgatatttatttcagagctataaattaatgcttttaaaagatggatcaaattgtatggtcattcagctttgatgtaaagcttatagggcctttatcttttaaaaagtaggctgggtatgatggctcacgcctgtaatcccaacactttgggaggctgagagaggcagattgcttgaggtcaggagttaaatacaaaattagcctggtgtggtggtgcatgctgtagttccagctatttgggtggctgaggcacaagaatcacttgaagctgggaggtggaggttgcagggagctgggatcatgccactgcattccagcctaggtgacagcctaggtgacagcctaggtgtctcaaaaaaaaaaaaaagtattctaatgcttatatgtggtaattattctatatgtatattgtgtttagaagtactcacttgcccctattactatatgccctacccaagaaatggtagacgataccatttgaaaaatatgtttgattgtggactgtgattaggaacttacattattttattttgaatgttattttctgatcattaaaaagttatttacaaattcctcaagtgatttattgtgattaagtagcttttctatattagacaacatcttgcttagttttgttacaattctactttgaatgttcgtggatataaaaatttaatttctggaaatgaagttcaatcaaaacaagaaaggtcatgttattttctcagtcataaccatactagcctgtaatgttggaagttttttcctctggtttcatcccacatggaaattcctgtgaaattcagccaaatatatactatttatttctagacaaagctccttttacagttccctgcctccttttattagagaaaactgaatggccaagttagacaaagagatcaccttttctcttctcctgatatctagaaagaagcctcaaagacttgttcactcttcctctcttctgttcttccccacttcctacctcttagcttttcagagtctaaggcctccctgaagttaacatgagtccaaggaaggaaaaagccttcagttatccaaagttctttctttaacctgaaataacctagagtcagaagtcctttggggctttttaaatgatttttttttcacttgtacatgtatcccccatcacagtctctggtgttagaaagagaagtgggggaatatttgttgccaaggggtgctgttgtttgtcttctcagtacagaatgtgcagtgctatgatggctattacctggatcttctacattgtttgtccttggtggttctcagtgccttcgactgagaaagaaggggaagagttgagatcgacaactgtatttgtttgagaaaatttagtaatttgagtgaggtgggtgatctagatgctatgttggcaaactgtcaccatggacattttttcgttgattattagagaagtataaaaagtgtccctttgattattacagaactagaaaaagaaccaggaaaaagtcaccagccttaggaatatataccctaaaatgcacaggatgaatgatatatattagtcaccaaatgctacagacagaaaagtgggttgtgctgaatttaagtgaatcctgcccctttctccttttaattcctttcaaatgaacacaaaagcagctgtaaagtgaatccaggaatttgcattatttaaatagagatgttactgctattgattattaaaaaatagttttgaaataattttacacttccaagaagttgcaaaaacagtttagagagttctgtgtaccttttttgacctggtgctctagttgataacatctcacataaccatagtatgatattaaaaccagaaaattgacattggcacaatattactaacttaaactatagaccgatgtgaattttatagggttttctcccccagtatataaacttaagggattagctatttctttccccgtcaagtgtccttgaggggtttgggccatcaccctgaaagaccaaatcccgaatagcataattgtaattgccgaaatcctgaaagattaaaatatctaaagtctaaaatcctcaaaatcacaattctgaaatctcaaaaatgtaattctagaaaaataataaaatgttctttaaaagatgtttatttacattttaaaaggcaatttacttgagaaacataaaaacacagcagagcacttcatagatcactttacacaataaaataggcaaagtaatgtacatatttttgcaatcataaacaggtatactaacaacagccacaatctaacaattatgagcagatgaactgtattcataaacaaatagccctcaaaacaatatgtataaatgcttatcactatgactggtggttgtgggctcccaggtttgtaactgcagtcaccggaaatactctgatgcacaactgaagtcttttgacaaaatcattcgaaaacctcaagctcgagaccagcctggccaacatggtgaaaccctgcctctaccaaaaatacaaaaattagccgggcatggtggcagacacctgtaattccagctacttgggaggctgagacgagagagtcgcttgaacctggggcagaggttgcagtaagccaacattgcaccactgcactccagtctgggcaacagagagactccatctcaaaaaaacaaacaaacaaacaaaaaccccaacgggttaccactctttatgcagtcactcaaagaattgagatctcgagatattttatgtttcacaaatgcagatatacaaaaatgacatctctacttattgtggaagtttcaacatttttacatacatacacaatacttacacacaaagtcagtgttgtgataatgcacttttgtggagtcatatttgtaaaaaaaaaaatgcataaaaccaattagaactctttagaagtctttatacaatttgtacttccagtatcggaaaagatgcaaaaatgaaatacatagcatagcaagttggcactatgtgtgaaggggcggaagttgtacatgattaaataatttggcaggggagatttcttgtgttttttgcctgcgttttcatttctgtgatcttcaaaatgtgaactgtacttgtatttggagagtggttgtggtctagaaatttggtgagtatatattctccatctgaaagtctagttattgctcggccattggaaataagcaattttctgcttttgctgcatcaataataattaactttcgaacttctttcaccattaagtagccttgtacacataacttatcacaaccccttttcgtgagagaacaatttcgcatatctcttccactctgttgtaaggaatatagtaagaaggaattgtatttggcttctccaataccaaatctattttagtcacatttcttctgaaagacagaatcaataggacatgtatatagatatatgaggggaccgattaggataattggcttacatgattacagtagctaagttgtgtgacagactatctgcaagctggagactgggattctggtagtgtggctccattcaagtccgaaggcttcagaacctgggaagtgggtggtgtaactctcaatctgaggccaaaagcctcaggacccagggggctgctggtgaaagtcctgtagtttaaaggctgttgagcctggagttctgatgtccaaaagcagcagcagaagcctgtcccagctctcatagagagttcaccttctgcatttgttctctctgggtctctggacaattggatggtgcccatcaacattgagggcagatctcccctgtacactactcagactcacatactaatctcctctggaaataccctcacaacccccaaccccaaataatgctttaccaggtttctaggtattccttaagccagccaagttgacacttaagttcacaagttcaccccttgtcaactggcacccatacacatctccttaacttccaaataaagacagtaacaaggtaatagttctgcctaacagatgcaactatcctgtgtacaactgaaaatgcactaattccctccccaggattaggctttcaggatttcaacatttgggattttaaccttttgggattgtgattttggggattttagatgttaggaagtttagacttaagggattttgatcttccagaatttcagcatttgggattatggtgtgtgggactgtgtcttttgggattattattagcactagttttttatatttattccaaatagttacctgtatcaattgttttttcttttttattgctgactggcattccattgtgtgaatgtaacacagtttgttgatccattcagctgttgaggacatttgggttgttttgagaatttatgtctgacactttgtgtcctacgaattttcagcttctttttaaattcccatctggtcattggtaagaaagagattggggaaagctcaaaagcaacgagaaaaattctagttgctaacttagtatttacgggaagatgaagctctatacatcaactacacttagcctcctggcatcttatcctcatttaaattaatccctgggctggtgttaggtaaacatctgtagttcactgtagagcttggtaagtagaaaacttccattgctgggttagtctatgtgcagatatgttcttgccccttgacatgtttcaccttttgccagaataggatccttctgagaaaggaagaaattactttctttcatcatagtgcctctaccctcacaaacagttgattcatagctgcattctgtaaagtctataattatacccactttgaagcagtccctgtgtatgtgtatgcagaaattggggtacatggcctgcaatcggatattactcatctgttttgtgtaaatgatgtattgatcactgttatgacaagaaagggtgggggatacattcagattgagtaattggagagagtttaataaagaacctatttacagttgtgttgtcaaggttaagggaaactcacaagagatggtaaaccgtctcagagtgcttaatgtctctggcctacagagataacgggaggaagaagaaagagtatctgtattataaattggggtgcctaaggggagccaagactttcagaagaggaatgcaggcaacctgtagcaatcctgcaagaagccctgtgtctggggaatacatctcctgacttcactgttttcaccctttgatgtcctgccagtgactccagtggttgaaaccaaccagaagccagaggacatgggagcctgttaatgcctttctttaaagactgtttttccagagcacagagcagggttgagaaggatagaggatagataagaaggagtaaatggaaaacgtcacatattggtgtttttgagctttgaatggagaatcttgattgcatctaggagggtcctgtcagaaatgggtatataatagacggtccagtgagctcttgctgcctttaatttaatcatattcatttaaaggagacttttagatagatctcttcagaatgaaattccagttaggtggacccttgctttttgtttctgtaagagccacatgcagtggttttcttttttcattttccgctacatatgatttgtttagctttaatgttttttgtttttttgtttgtttctgtattgggcaacctctagtggtccttaggaaaatcacatttgaatatgaacctatagtcttatcaaatattttgtttatacatcctgttgtcttctgacatcatatttctgttattatatagtaagtaaaatgtcaaatgataaagatcttgggcttaattagaaagaacacaagcaaagatagtggacaaatatctcattttaaaataattgtcctaatattgctaagtatagatagttatgaaagaggtttttctgaaaacacttaaatgataagaaggagccattctcatgaaaatgtgggactgatatgttccaggtggaagggatagcaaatgcagtggcactgacttaaatatcaactttgtgtttttgaggaatggaaagaggccatatgtaagtgtgacttcaacatagcaaggaggtagggtattagacattaactctgagggggagtcagggctagattataaaaggtcttgatcatggtcagaagttgtgattttattttatgcacagtgaaaagcaactggaaggtgttagggacaggaatgacaaaattctggcctctgggcagaggaaggtttatagaggatggtcaagaggaaaagaattcagtaaactagtttttacattagtttgtatgaggaggacaaaagataataagtagataaatagcagtgaaaaatggagagaaactgatggatttgggatagattttgaaggtggaatcagaaggacttgctaatggattacatgtaataagtgagggaaagagaggaattaagcttgagcaacttggtgccatgttctaatttggaggaagactaagaaagggataggtatcaagaggtctctttttaccatgtaaggtttggccagaaatgtagcttagttgtttgtatatgagttaagaacgcatgtttctcttctagcttattgtatttactctacttttggtctccttttatcctcttttagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtaagggtagtacatagtatcaaaaatacaggtttttcatgtaatgatttaacttccactttcaagtaggatataatgggccatggcagggtgttgctgctgctactaacatgtggataaattataaaaatcatcgcactttaaaagacatcgcagaactgtagaagcaaagacaaatagatggatttaagtttcagagtcagcataacattttagaactgttttctccccaccttgggggatacccactcagcccagaggcatggcctgttggaagaaagagaaactagaggagcttttagtgattgcctgggactagggcgacaaattagagatttttctcacaggacatttgctgaattttgaatttgcaccaagagctaaagagctaggctgaaagcttctgaaaggcaaagtgaaatcccttttagtcttctgatgcttaggaaacaaagacgagctaggagaatgggcttgaaaaaacagcatgcaagaggtaaaagcccaagagagaatggtgaattgatactgaagatctgcaactgctctcacctgggtgaacttactaattctggccacagctggaatctgagcattcagcctcaactttattgagaagctggtgaggaggtggagaaaccagcagacatcttggcaatcatgtggagcaagagtgacacaactcagaacttgagtgaccttgagcacaaggccaatttctctcaagttatttgcgacattttgaagctttatgggatggaaagctaaagagctaagctgaaaatttctgagagcagacctaaatctctcataattttttcagattgaggagtcaaagactcattagactgccaattagtggggggtgttgtggggagatataccctggcaaaggagtgaaccagagctggactcaaattacaaaagttataatcagtcctaacccagatcaattcctgattaggttgaggtaatcagtccttcacccagtctgcctaacagaggagagaggaaaactactctttgattgacaataacaccatttagtacttctgtggttctttcatatactgcactagacacaggacaaaggaagaagctggaaatgaagggaatgattcctggagataaagaagtcactctctttggaaaatatcaattctaactggcctacatgaaataacatactttcaaaatatatgacaaaaatgagtagaactaaaagaggaaatagacaaacccacaataataatggaaactttaaaatatctttttcagtagctggcagagcaaggagacaagaaaatctataagatcacaaaatatctgaacaatctatgaacaaactactgtatagacatgtagaacattgtaccttatagtgatagaatttatatatcttttaactgtacatggaaaatttaccaaaatgaccatacgctggaccacaaacttcaataaatttcaagatattgaagtcacttagagtttgtcctctgatgacaatgggattaagctagaaataaataacaaaaatgattaccatgatatctccagttggctgaaaattgaacagtatacttataagtaatggatggatcagagaaaagaatcaaaatggaaatgagaagatagtttgaagtgaatgataatgaagataagccatataacaacctgtaggttgcagctaaaatagtatttttaaacactgtttcccctctagggaaattcacactttcaatgtatattttagaaaagaaaggaaaataatcagtatttaaacttccaactcaagaagcttggaaaagaacagcaaatcaaacttaaaggatcagggaagaaataataaagataataaaactcagtgcaataaaaaacataaataagctggaggttcagctgagagcttaactgaccgttgtggaaagggcagggagaagagggagagtgagtgtatgtgaatacaggaatgagggaaagcttgtccacttttgagtataaactaaagggacccatgttatcatgtgttcatgaagattaatatgtgcaagtatttctctttaattgaaatttttaaaaaacttaatagaatctctagaactaaacagttcacaaagtcaagacttgcaaatttgttcatttatttatacttatacttatttactcataagtaaattgtaaataatattttacatgtgatcttaactaaaaagctatgagtcaataagtaatatactatattatattacgtttatattttgagacagagtttctcttggttgcccaggctggagtacagtggcacaatctcagttcactgcaacctccactgctagttcaagtggttctcctgcttcagcctcccgagtagctgggatttcaggtgttcgccaccatgcctggctaatttttgcgtttttagtagagatggggtttcaccatgttgacctggctggtctcaaactcctgacctcaagtgatctgcctaccttggcctcccaaagtgctgggattacaggtgtgagccaccgtgcctgtcccaatagtattttaaatattagctttttaaatctcttgtgtttttttattccttatatataaatggtcaaaaatcataatttgcttaacaagttagcttttagttataaatatctctatccagattgattatcagttactgagaatctaattagtaaagtttttccataagaaatgtctttgtaagctgggcgcggtggctcacacctgtaatcccagcgctttgggaggatgaggcaggcggatcatgaggtcagcagttagagaccagcctggccaatatggtgaaaccctgtctccactaaacttaaaaaattagccgggcatggtggcacacgcttgtagtcccagctactcaggaggctgaggcagaagaatcccttgaacccaggcggcggaggttgcagtgagctgagattgcaccactgcactccagcctgggcaacagagtgagattctgtcttaaaaaaataaaaataaaaataaaataaagtctatataattttttttaaaggtggtatgttattttgctatgatgtttccatgtatcagagtaaagatggaaaaccattgaacagactgatggccagcagagggcgaagtttcaagcagacttcacttgctcttgtacatgaggtaggttcccgtgtcctcttctttatgttttagtgttttctcccttcatgatatgtttaagaagttgtttgtttagaaataatttttttgatcataattaatgtaagttgcttttaaaggccaccaaaatagttgacccaactgaatactcaaatatttcaatgtatttctgaaagaaactgccatgttttcccccactgcccagcgtatttattagggagtaatgtctaggaatttgctttacttcatcaatgcttaactgtcattattcagaataaatatcaatttattgtttaaagaaatgctactgcctatatcttaattctaatcctttgcaattatgtaggggaccagtgtttgtattttgtgagtgtttggaattaaaagtaaataaaagcattttagaaaaataacccttggttttaatgtttattttacttttcctttcagctaccttttaaaaataaagttctgtgattctattagatgatttatatgaaatctgattattgcagattatggcaaaaccaggggaagagggaagctggaaagtccttgggaaatgtatttttattgtttttaaatattttatcacacttactcatatgatgtatacaaattaaaatgtatgaatgaataacaaaacaaaatgtcacagcaaagagatttatatagttcagacatagtaggttatatatcagttataagtaaaaatatatgaattgtaaagatttaatgaacttgatgtaaaaataattagcatttctaaaatatctttctataacatcttattttgatgcctaatttatacatttggttgtaattaatttgattcacttttattctgtatcacaccaattgccaccagtttcatagcacagcaaaattcagagggtttttcaagacccatctttgtcctttgccatccattttcctttcatatatttagttagaattaaaattgtgtaaatacttgtttcagaagctttttttttgcctaatatagtgtcttcattcaactaaaaagagaagaaggatctgggaagagcaacgcttttctaggaggaaggtttaatttcagacataggtgatttctatgttttttttgtccctggcatctcattagttggcatagagaagggagaaacgtggtacctttttgtgttttaagctgtgcacttagatatttgaaggaaaactgaagtctaaagtcttactgaaaagctgatttataataaaaagtcaccatcagaacagaaacaagaaaaagcattagtgcaggggatggcagaagacatctgataacttttggcagtggcatcagaagttatgaggtgtgtccgagatataagcacagaaaatctttgggttaagatacttgttgcttgtgctgtagagagtctagaaaatttcaaagggaaaagaaaataacatcattgttttaggggtcaattagaaggcgtattggacagaattctgccaaatgtatagtaggattttagactggattccatattctgctcagtatatgtagttcatttgcttaaaacacaaaggctgggggacccatgaagtttctcaaactatgtgacaagaaataatatgaactttcagagctggttaataaaaataattgcaataataacagctaataatcgatttagatactttcaacactgtgaggtaggtgctgttaatgtgtcaaggtcacatagctaacaagtagaggagcctggaaattgaacccaggcagtgaggctccatagtccttgaactgtcatcttctctcccaggttaatcagagaagattctagaaatacatttggatttttccaagattactctaagctctcttaaatcatctccttgcatcttgtctttcttttgttgcaatcaatttgggatttttccagatgaaatttcttcaaaccctgcttttgatcctcccattactttatcctgagtcttttttatttccaagtatttcttctttctttcctttttctttctctttttttttttgagatgaagtctcactctgctgtccaggctggagtgcaatggtgcaatctcggctcactgcaacctctgcctcctgggttcaagggattctcctgcctcagcctcccgagtagctgggattacaggcatgcgccaccacgcccagctaatttttgtatttttagtagagatggagttttaccatgttggccaggctgatctcgaactcctgacctcaggtgatccacttgcctcggcctcccaaagtgctgggattacaggcatgagccactgtgcccagccatatttccaagtatttcttgagaattgcagtttgtttattaattcaccagttgatggaccttcgggttttttctgttttcaatgattaagactaaagtttctataaacattctcatacagatccctgtgtgaacattcatttttctgtttcttttcagtaaacaaatacctaggagtgagagtgcaacgtcatgtggtaaattcatatataactttataggaaactatcaaactgttttcctagtggctgtcttattttgaatgcccatctgcaaggtatgagagtttcagttgctctgccttcttgtcagtgcttgatatagtcaattaaaaaaatttagctattcttgtagatgagtagtattagtttccctttgtggttttaatttgtgtttccttaataactaatgatgttgaagcatcttttcatgtgtttattttgtatgtatctgttttcttcctgaagtgtttgctctgatcttctgcccatttttagaattggggcttttgttttcaaaagagtgttctttatatattctggatattttttttttttttacttagtgtgttacatgtcttttcattttctttttttttttttcttctttttttttttttttttgagatggagtcttgctctgttgcccaggcgggagtgcagtggtgcgatctcagctcactacaacctccgcctcctgggctcaagcgattctcccacctcagtctcctaaatagctgggattgcaggtgtgcaccaccatgcccggctaatttttgtatttttagtagagacggggtttcaccatgttggtcaggctggtctcaaactcctgacctcatgatccatctgccttggcttcccaaagtgctggaattacaggcgtgagccactgcgcctggccttcatttttttataatgtattttgaagagtggacttttcattttgaagaatttcaacttaccaaattttacaaaatggttcttgctttttgtttaatccgagattacaaaaatttttcattttcttttttcctgtgttttatttttattcttttaaattacttttagaaattgaggtatggtatggtttggctacgtccccatccaaacctcatcttgaaatgtaatgcctacatgttgcggtaggaacccagtgggaggtgactgaattatgggggcgggtctttcctgcactgttctcatgatagtgaatgagtctcatgagatctgatggttttaaaaacgtgagtttccctgcacaccctctctctttgcctactgccatccatttaagatgtgactcgctcctccttgctttctgccatgattttgaggcctctgcagctatgtagaactgtaagcttattaaacctgtttcttgtgcaaattacccagtcttgggtatgtctttatcagcagtgtgaaagtggactgatacaaggtgtgatacatataccataaaatttacttatttaaagtatacaactcagtggttttcagtgtatccacagagttgtgtaaccattcccacaaacaattttagaacaatttcattacccagaaaagaaactgtgtacccatttgtagtcactcttcattttcccttgtccttagctttcagcagccactaatctactttctgcctctgtagatttgcctattctggacatttcatataaataccatcatacaatacatggtttttaatgtctggcttctttcacttagtataatgttttcagggattttccatgttgtagcatgtattagtacttcattcttttttgtgtgagaataatacttctctgcatggatataccacatttaatttatccatctttcagctaatggatctccttctgtgttttcttgtagaagttttacattttaaggtttactttttagcttaggtccatttgagttaatttttgtataatgtatgtgttatttgttgaaaataccatcttttattcactgaattacctaggcacttctgcaaaaatcacttgcccatatatgtttgggtctatttctgtactcacttttgttccattgagatctgtagatttgtgctttcaccgcaatgacatacatagctgaataactttcgctttataatgtcttgaaatcaagtagtatgagtcttccaactttgtttcatgtttcaaaaaaagttctgactatgctagatctcttgcttttctatatgaattttaaaccagttttaagaaaccacaaaaaagtttgctgatttcaatggtaaatgcattgaatttgtaggtcaacttgagagaggactgacatcttggtaatagagtatctagacccatgaacaaggtataattgtctatgttgattttttttgtattataaatcttggacatattttgttaaagttcgtaagtattacatatccctaagtattttgatgctattcaaattggactttttattttaattttttactgtttattgctagtttataatcatccaattgattttttctatgaccttactaaaccaacttatatattcttacagtctttttgtaaattatttttgtttttcactgtaatgttgtctataaataaagatgcttttaatttttgcttttctgatctgtatgcctgtcaattgtttttattgctggactgcactatctagggccatcattacagtgttgaataggactgatgagagttaatattcttgtctcgttcacttaggggaaaatattcagtgtttccctgtttaatatgatgtttatatacagattttgtcgacttcctttgtcaggttgaagaagtttccttctagtcctagatttctgagaggtttttttttttttttaatcacaaatagatgttaaattttgtaaaatgctttttctgtatcaattgagatgattcaacgcttttaaaatttgttgatatgattacttattttgattgattttctaatgtaaaccaaccttgcattcctgggatacactccgcttgatcatagcctatttatatattgcttcattctgtgtgctaaaattttgttaataaggatttttgcatctgtgctcatgagacatgttgttctgtagttttcttgtagtaattttgcctggttgtgttatcagggtaattttgtccaaataaagcaagttgtgtagagttcccctcttttttatttcccgaaatagtttgtatagaattgttattaatttttccttaaatgttgggtagaattctccagtgaaagcatcttggcatggagttttctttataggactgtttgtaactgtgaattccatttatttagtatacatgaggctatttttttttaatctacctatctgtgtatctacctacagacacacctcattttgttgcactttgcagatactgcattttttacaaattgaaggttcgtggcagccctgtattgagcaattatctaggcaccatttttccaataccatatgcttacttcatgtctctgtgtcacattttgctaacaaaatgtgaaatatttcttttttatcatcatgtctgttgtgatgatctatgattaatgatctttgaagttacgattgtaattgttttgaggtataacaaactgtgcccacatagcaccatgaacttcataaatgttgtgtgattttttatttcttcaccaaccagatgtccccccaattgggcctccctattctctgagacacaacaatattgaaattaggccaattaataactacaatggcctctaattgttcaaatgaaaggaagagttacatatctaccacttgaaaccaaaagctagaaatgattaagattagcgaggaaggcatattgaaagctgagataggctgaaagctaggcttcttgcaccaaacagccaattttgaatgcaaagaaaaggttcttgaaggaaattaaatgtgctactccagtgaacacatgagtgataagaaagcaaaacagccttattgctgatttagagaaacttttagtggtttggataaaggaacgaaccaaccataacattcccttaagccaaagtctaatctagaggaagactctaacactctttaattctgtgaaggctaagagaggtgaggaaactgcagaagaaaagtttgaaggtagcagaggttggttcctgaggtgtaaggaaagaagcgattttcacaacaccaaagtgcaagttgaagcagcaagtgctgatgtaaaagctgcagcaagttatccagaagatctagctaggatcattgatgaagatggctaaactaaccaacacattttcaatgtaggtgaaagagctgtctattggcagaagatgccttgtagaaattttatagctgaagagaagtcagtgcctgaaggacaggctggctgtcttgttagggtctaatgcagctgatgacttaagttgaagccagttcaactttacttaaaattctgaaaatctgagtgctctaaagaattacgctgaatctcttctgtgttctagaaatgggacaaggcctggatgacagcatatctgtttatacatggtttactgaatattttaatcccacattaagaactactgcttagaaaaaaaaagattcctttcaaagtattactgctaactgacaatgcacctagtcacccaataggtctgatggaggtgttcaaggagatggagttgttgttatgactgccaacacaacatccattctgcagcccatggatcaaggagtaattttgactttcaagtcttatttgagaaatgcattttgtaaggctatagctggcatagatagtgattcctctgttggatctgggagaaataaattgaaaaccttctggaaaggatttaccatgtagatgtcattaagaacatccgtgatttatatgaagaggtcaagatatcaatgttaaccagtatttataagaaattgattccagccctcttggatgaccttgaggggttcaagatttcggtggaggaagtcactgcagatgtgggaggggtaccaagagaagtagaattagaagtagagcctgaggatgtgactgaactgctaccgtcatgaggagttgcttcttagggatgaacagagtggtttcttgagatggaatctactcctggtgaagatgctgtgaacatgttgaactgacaatgcaggatttacaatattacataaacgtacctgataatgtggtatcaatgtttgagaggattgattccaccttagagagaagttctatggatgaagctatcaaacagcattgcatgatacagagaaatcttttgtgaaaggaaacattaagcaatggagcaaacttcattgttatcttaagaaattgacacagccatcccaacattcatcagccaccctaatcagttagcaaccatcaacatccaggcaagaccttccactcacaaaaatattaggagttgccaaagatttatataattatttacattttttagcagtcaaatatttaaaaaaaaatttttagtgataggacctcactatgttgcccaggctggagtgcagtgactatccacaggtgcagttacagaacactacagcctccaactcctgggcccaagggatccttccatctcagtctcttgagtagctgggactacgggtatgtgccaccatgcccagcagtaacaaagtattttaaaactaaggtatgtacattgttttttttaaatacataatgctgttacataatagattatagtatagtgtaagcataacttttatatccactgggaaacaaaaaaaactgtatgactctctttattggattattagctttaatgcatttgtctgggaccaaacctgtctgaggtgtgcctgtacttcctgtgtacatatagtgggatagttttccttttccaaaaatgctactattaaattagtgataaatctaatgattgcggtggtcttactaagaaataggatcttactggcatgtgaataagcccttatgtactgtttgtgttgttattcatttctattaataacagcccctaaagaatccatatccttacaggatattctatacccttcacaatggctacaactacatgagagtgagtgagcgagtgaataaatggctaaaagaactttattttgaatttagatgtgctctgtcctcatttgtaaaaacagactttattttttagagcagttttaggttcacagcaaaattgagagcaatgtatggagcattcccatacaactccctgctcactctgccctcatgcctacctctcatcttcccattatcccccaccagagtggtatatttgttacaaataatgaacctacattgacacattcttgttacccaaagtctatagtttatattagggtttattcttggtgttaaacattctatgggtttgaacaaatgcatagtggcatgcatataatcatataatcattttagtatcatacacagtagttttgctttctaaaacccttctgcaatctcccattcatcccttccttctctctaactccgtgtgaccactgatctttttactgtctctatagttttgccttttccagaatgtcaagtagttggaatcatacggtatatagatttttcagactggctgatttcacttagtattaggcatttgttttctgcatgtattttcgttgcttgacagctgacttctttttagtgttgaataaaaatccattgtctagaaatactacagttgatgtatccatttacctacagaaggatattttggttgcttccaagttttagcaaatatgtataaaactactttaaacatctttgtgcagaattttgtttgaagataattttcaactctcgggtaaatgccaaggagcacacttgctggattgtatggtaagagtgtgtttggttttggtaaaaaatggccaaaacatcttccaaagtggctataccatttcgcatctccttcctcttgctccaaagccttgtcagcaattggtgttgtggtctggattttggccattctcattggtgtgtagaataacatttcattgttattttaattcgcatatccctgatatgtgaagcattttgtatatgcttattttttatctgtgtgtctatttctttggcccattttaaaatctggttgttaggtttttcatagttgagttttaagacttttttcgtatattttggataatagtcctttatcagatctgccttttgcaaatattttcttagagtctatggcttatctattctcttgacagtgccttttgtagatcagaagatttttattttaatgaagtccagcatatccattgtttatttaatacatagtgcctttgatattgtttctgaaaagctgtcatcaagcctaacattatagatattatcctgtgttatcttctaggaatgttacagtactgtgttttacgttgatatctataatctattttgagttaatttttatgaagagtgtaaagtcagggtctagattctttttattttgcatcaagatatctggttgtttctgtatcatttgttgagaagattatcctttctccattgtttgactcattctcaaatattaacggactacatttatatacgtctgtttctggactttctattctgtttctttgatctatttctctcgtcatttgctcataccatgctgtcttgattactgtagctctatagtaagtcttggagttaggtatgtcagtcctccaactttgctcttcttcagtattttgttggctcttctttgtcctttgtctcttcatatgaacatttgaatcaatttgttgttatccaggaagcaacttggtgagattttgagtgtgattgcattgaatgtatagatgaagttaggaagaactgacatcctgacaatattgagctttcaaaaatccatgaacctggaatatttctctatttatttcattcattattgatttctttcattagaattttgtaatttttctcctatagatattatatacacacacatatatatatgtctgcgcatatatatgtgtatatatatagatatatttatttatgtaggtttatacataagtatttcatttctggaggtgttaatgtaaacgctattgtgtttttaatttcagcttctatttttttcattgctgtcatataggaaagcaattgatttttgtattgtaaccttgtatcttgcaattttgctataagtgcttatgggttccaggagttttttgtcaactttttcagattttctatatagacactcatgtcatctgcaagcaaagacaattttctttctttcttcccttcagcatacattttactttctctttttggcttacatcagtagaaaggatttccagtatgatgttgaaaaagaatagtgagagaggacatccttgccttgctcctgatcttagtgggaatgcttgtagtttctcaaaattatgatgttaacggtgggtgttttgtagatattcttatcaagttgaggaagttctttatttctagtttactgagagtttttatcatgaaaaactgttcgattttgtcaaatgctttttctgcatctattgatatgattatgtgatttttcttctttaccctgttgatatgtgggaataaacattaattgattttctaatattgatttagtcttgtgtaccaaaatccatgtggttgtggtgtataattcttttttacattgttagatttaatttgcgtatattttgttgaggccttttacatttatgttcatgaaagatattgctgtgagatttcctattcttgttaatacctttgtctagttttaattttagggtaatgctgacctcatataatgagttaggaagtattctctctgcttctgccttctgaaagagactgttgggaattggtgtgatatcctccttaaatgtttggtagagttcaccagtgaacacatgtgggagtggtgctttctgtgttggaaggttattaattgtcaattcaatttctttaatagatacaggcctattcaaataatatatctttttttcatgtgagttttagcagattgtgtctttcagggaatgaattggcccatttcatctaggttatcaaatttgtgggcatagagttatatatattatttccttattatcctttcagtggccagagagtctgtagtgatatcccgtctttcactgctgatgttaatttctaaatttgttgaatttgttaaggtctgtgttatggttcttttaaatttgttaaggtgtgttttatggttcagaatgtggtcagtattggtgaatgttacatgtgagcttgagaagaatttgtgttctgctgccgttgcataaaatagcctgtagatgtcagttatatccagttgattgatggtgtttttgagttcaactgtgtctttactgcttttctgcttgttggatctgtccatttctgagagagaagtgttgaagtctctggctatacgagtggattaatctgtttcttcttgcagttctatcaggttttgccttatatattttgatgctttgttattaggtgcatgcactctaaggattgttatgtcttcttcgagaattgacccatttattatataatgtccctctttattcttgacagctttccttgttgtcaagtctgctctgtctgaaattaatataggtcttcctgctttcttttgattaatgttagcatagtgtctttctctatccatttacgttttatctgtatgtgtctttacattaaagtagatttcttgtagacaacatgtagttgggtcttggtttttgatctactttgacaatcttaatttgcttccaaaatgattattgatatattttgattaatatcttctatatttgttactgttttttttttctgtttgttgctcatgttctttattctgcttttgtattctttttttgtccttacggtttcaactgaacattttgtatgattttttctcttttgttagcatatcagttatgtttctctttttactttttaaatgattgccacacagtatgcaatatatatttacaactatgtctacttgcaaacaacactataccacttcacaggtagtgcaaatactttataataacaaataatcctaatttttttctctcattccttgtatcattgctgtcattcatttcacttatacataagcatatataatcaaatacatgactactattattatttttaacaagctgttatctgttagatcaattaagaataggaaaataaaagttttatttcatgttcacttatccctcctctgatgccttcctttctttatctagatctgagcttctgatctctataatttgcttactccctaaaaaaactttaaacatttcctgcaagggaaatgtacgggtaacagattttctcaaattttgcttgtctgagcaaggctttatttctcctttatttttgaaggatcattttgtggggtacagaattctaggttgtaattttcctctctcagcactttatttcactctcttctcttcttgcttgcatgttttctggtagaaagatggatataacacttatctttgcttctctatatgtatggtatctttccctctggcttttttcagaatttaaaaaaatcattgcttttatgtagtttaaatacaatatacaaatacctataggtttttggcatttatcctacctggtgttgtctgagcctcctataactgtggtttgatgtctgacattaatttgggagcatctcaagatgatttcaaacatttcttctgttttttttttctcgcttatttgtctggaattcctattatgtgtatgttataacttttgtagttgtcccacggttcttagatattctgttttctttgctttattctttttcctcttcgctttttagttttagaggtttccattgagatatcctcaagatcagagattatctcctcagttgtgtccagtctgttaataagctcattaaaagcattcttcatttctgttaccatgcttttcgtctctagcatttattattttggtttttatatctctctgcttacattgttaatttgttcttgcatattgtctttattatcttttatggcctttagcacattagtcatggttactttaaattcccggtctgttaattccagcatccctgcttatccttacttggttctgatatgtgctctgtctctttaagctatgtattttaccttttagtcttccttgtagttgtctcttgataaccagacataacatactaggtaaaaggaaataaagtaaataggtctttagtaatgtagtggtaaggtgttgggggagtagagtcattccataaccctataattaggtctcaatctcatagtgagcctagaactttcacaagtgtttctcaggatttggatttttttctcttttttaattccttaggtgggataggatggctagaatgggctagagttgtctgtttcccttcacccacttagaaggctagaggatcttggagatgggtattgctttcccccaggctggttaggtgctgataaaactcttattaggttaggctctgttaaatagattttttctgatggcagaccttgttaagaatagaatgctgttatatttcaaagtgtttttcccctctccctgctgtgatcacaaggtgagttttttctgatattcactatgagaactgactgagcttctggagctaaaactcataaaggtgtggggaccctccctatgcctgggtacacctagagtttttaattctcagacttgtccattcttagcctccagccattcatcagctatgattcaggttttcctgccccagccctagttactgtggtggtttctgtctgtgagtttctgctttgataagctgtgattctctctgtagctgcctgtctgtctctccaactttgagagtagcactttgctctgtgacctgattttcttttacagatctcataacagttgttggttttatagtttgttcagctttttacttgttgttaagatggagtagtgacttccaagctccttacaggctggactagaaaccttcgctttccatattttgaaatgtattttgttttgtgttcattgttgatacttcttgagctacatggttgctaaactaagtaattttcaatgctatggagagctagctgtttaatgtaatctgtgataaatttccttggaaagtattatatcctcttattttcaaaaactttggattttttttgtcttttcttaaagtgaaattctcccctgttacttttagaagaatcatagacccaagtttgatttgggtttggcctgacataccaggagcagttctgcagaatgacagtcttgtttggacttctccaaaactgaagtggcctctctctctgctcctctgtacaggggacatgcagtggtcatttcagatgtgctagggcttctccaagctcaagtggcgttcctcttttgttcttatgtatacctacttctcatcctgaggtttacttgactcctgttgcagaggaagctgaaggtgaatgatagtttccttccctgaaatttgctgccagtcttgttatccttggcatttctaactctgacatgacactctcacctaaattggctgatgctgatttctccctggatgagaatggcagtctggattcattactttctcctttcttgggcacatgcaaattttcctgttcttgctgctgctacccaaccatatttccgcctcagcattaggtaatgagctctcttttcatttttatttcagagaaaacttatccagacctattggcagctctgttctaaataaaatctttagttctacattctttcttctttttttcaagtgataatcatttgattctttttacctaataaattaatttttttctgcctcctttaaattttttccctagaaaagtacatatgctgtaaccaatcatttaaaatataagaagtgtatttgcctttttctttcagtgtcatctttattttaaaaaacatatttgatatgaagtacaaggaataatgttagcatctgtgcaatatgaaacaattaggtgaacattgtgaataataatggggagaagtggtatctgtgcttattacacatttcccctagaaaatactgtgaaaagtatggtttgctgtattttagatactccataattaccatgtggatgtgagttgttatggtaactgggtttctccccttctattaaataacagaataaatggttgcttgagatgtgactgaattgtcagcttaattgtcagctttcaagctaatgttaccctgattggaaacagtggagaggtaggagagaaggagggaaagagggaaggaaggagaaaaggttggggagagaatgttaaatttccagaaaacacctaggaagagatgagtgtcattttactttaaaaagtgtcctcccttctcttcttctcactatctgtcagaggacaggtctaacaaaaaattattttgccccaacaagattactgttgatggaatactgaagcccattatttcttgtatataaacaataggatattgagtggcttttggggtctctaataccagttgcaaatggtttttttttctgggaatgtggaaacaatgtgtgtgtgtgtgtgtgtgtgtgtgtgtgtgtgtgtgtgtctcataaagctaaatgtagtggttcagtatgcatatgtgtgtctgggtagcagttgaagttaaatacatttattttgataataacatttacatgtggcaaacatgaaaaatgcctttgtaagattggggttttaaaattaacagcaaatacttagtttacttgtcaatttttacatgctactcttccaatcccattctagttcgacaatcaaagaatgccatcaaagtttgttacctgatttatagtatttaatgaagggctgttataatgagtattttcttgtagatggaataagcatatttgttaagatcactcaagaggtggaatgcaataacaaatttttgaacaaagtattctgaactgtaaattaactaactagatggatatgtagtcccttgtagtaaaacatgtatgaggaaacatgattaccttttcattttctctcccatcattcccctacaattgcgaattatgtttctaagcagaacatttcctgttgtgatagtatttcaaatatacttaattaaagcttacatcatacagatttaaaagtttacagaatttcaatatataaaaattataatatctgctttaaaattttactgtgtcattcaatatgtttttatctggaattaaacctttcctggctagaacattttagacttgcttttgtaaaatctgcaaaactgtcttctcaacaactctgtgcctatttaaaaaaagttttaaattttgtgtttccagaatgatcacaacttgaacaccataattttctacaaatacttgcttatgatagtatgattttcacacgataggaatttgtcttaaagaggatgctacatatttagttctgttaaactccgcaggtccttaattgaacacttatgtgcaagacactgttatgggtaccatgggagggattccagcatgaatagaacatgacctctgctccttaggattgtatgagattaagatctaaagacagaatctgtggagtgttgtgggagaggcacatatatactggaagtatggagatgagaaaaattatttcagtaagtagaaatgagaggaaaatcggtcattcaaggaagaggaagcagtgagtgcaaaggtcctgtgaagtataagacaagcttgggaatcggttcgtaatttgatgcagccagaatgtaggttatataaaagagaggagcaagacatcaggtggagaaattggttaaaggtcttggccagcagttatttcttaaggtaattctaaaagactttgaacattatacaaaagagtttgggctttattctttaatgaaccatcaaaggttttgcaaagttctgagttaatgtattaacagtaagggtagcaccattggggatgtgttaggacaaggaaagattttaagctgttaagagatcagttactagatcatagtaatctaggcaggaatcagataggactaaaccaataaaggaaaaagttgggacatatatattaaatatttcagaagtagactcaagaattgagtctcaaggcaagggagattcccaagataaatcagaaatttcaaacttgggtaactggaacattgatagataatattgatgggaacaggaaagataacaggaagagtgggtttcgaatgatgatgacaaagaagtgtgcaaagtctaatagatggtgagaggtgaaagtttgagaagtacatgttctaaaacttgtgatttttttaaactaggtattttcaattctatttttatttgggtataatatgaatacactagagttctcacattttactgtctagttgtatgaattttggcaagtgcacacattcctccaaccagcaccacggtcaagatgagaaggttctaccaccctcaaacatttccccatgctcctttctagtcaggccctttccccacctccatctcctaacaatctcacatgaccaagagggctgaacttcaggctcctagcctcatcttcacttcatctagacaaattttacttcggttttctgtcttatatattggcattttactttatattgaatttggggtagggtagaaaaattacatagttaaatgtttgaaaatcatcattctactgtgttactgataaagctctgtctgagctgcctttatctctttcctggattgttgacgtcgcgtctgagtaggttttcttgtgttgacctttgctacctacagtctattgtcaacagagcagtcagtattgtccttttacaatataaattagatcatgtaattctttttctcaaaagcttataatggttctctctttagtaagaataaaagcaagtcctgaacagtgccctagaaggccctgaattctctgggtccccgttaattcactaactttttctctttctactctctgttttgctcattttgtctattgtagttagactgacctcttttctctttctcaaacaggtcagttgtatgcctgcccaggacctttgcgttaccattttttaaaattgaggtgtcattcacataacataaaacaaaccattttaaagtgtgcaattcactggcatttagtacatatacaatgttgtacaactatcacctctatttggaaatgttagttccaaaacatttcaatctcctcctttcatgtacccatgaaacagccactttctattccctcctcgtttcttcctgtcttccttcccctctcccccggcagctactaatctactttctgtctctatggctttacctattctggatatttcatataagtgacatcatataacacgtgaccatttgtgcctgacttctttcactttggcataatgttttcaaggttcagccatagtgtatcagtacttcattctttttgtgactgaataatatttcattatatgcatattacatattttattcttctagtttttccgttgatggacatttggattgtttctaccttttggctattgtgaaagtgctgctatgaacatcgatatacatggatttgtttgaatacctgttttcagttcttttgggtatatacctaggtgtggaattgctcagtcatatggtatttctatgtttagctttctgaggaaccaccattaagtgttttccataccagctgaaccattttttattcccactagcacttactttggtctttacatcctcacctcctccaagtttttgcccatactttaccttctctacaagatctactctaaccaccctatttaaccctgtaaccttctcgcatccctgccctcacctcattagcattcttccctcccatgtatatactcctattgtgggctcttctttgggcacatgtgtagtatttcattataattcactgcctcttacacattgaaacttgactgttagtcttccctaagccataggactgttcatctcaatgctccatcagatagctgtcattgcaagagtatgagtagttatagaaaaaaatttcacacattcattaaaactgagtgagacagtggttgagaaccctactttatcatctgctgaataactaggttgcaacttcatgatttgaacttattttgttgattggatttttttcaaaggcttctcacaagtatagcaaattggacataattgtcatactttataaatgctaattgaatttatttttcaccctagcaacattaacctaaaatataggcaatgtggctgactatacagtatattaaattgaaatagcattctaaaatgtgtttttgttaaaaatggtcagggaagtcctttttgcttgtgacacaatgggaatgtaagggcatgactttcttcaagctgtttctctaaagtctgtcttcattaagagaaaaagcaagaaagtgcatttttaaagagatttgtgcacagctgactccatagaacactaagtctagggtataatcccataaaacgtggggagttcaggctggcttctaggctgaagctttctactgtgctcctgtacccaccttcagctgtggttgaagcagcaggaagaggattagctttaaccttgagtttataacctccttttaaataggtttcctggcatgaatgttttcatgtttagaggctaaacatttgatttgctcattttcatttacattttttccataatcctttccttttttaaactcaagtttaaaaagcatttgtgagaccattgtcttccttgcaaattgctctttttgccaatttgctgaggctaagggtattctcagtagtacaatgatatctatggattattcggcaaaaatttaaaaatattttaagcttgtaaagtaagagataaacattttggttgtggtgattgagtattgtttctgttaaatccagctgtcaaaatagggctcgaagataattaatatattttatgaaaagggaacagaactgataggaaaaaagttgaagaaaattgcccacattttggaaataaagagcagagccaagacctgattaatgccttgccagctggaaatagagcctaggttgtagtttgccacctggataacaggagaagaagcaagagctggaggactcattccttcaaggatttatgttgacttattgacaaggctgccctcaccctgctcgttgtagtacttattcaggaaaagtcctgtctttataattacttttaagttcatttcatggctgagtatctgttttatactgtttgagattttttttttttttaaaaacagcaatgccatgagaagtaatagatagcagtaagaattaatctctttgttctttttattcccatggattcttcctatttgtgtccatttctgggtctctcactaggtggaaaagtctctgcagacacagactgattgataatctcatctttccacagtaccttgtatatagtaggccctcactaagactgggattaaagaacatactagaggccatgggaaccaactatattcagagaggctattatcttcttatcttccctatcacaaggcacttgagaatattaattcttataatacaataaaatgtccttaaacactagttatcatgattctggtgtaattacatacaaatttgttttctctctcactctctctcttttttttttggtctgtaggacacaaagtaaagttgtagctgtttgactttcgatgtgttacaggaatcatgaaatgtgatgcactgtgactgtttttcttgattgatctttctttaacagaagcagaccttgggaagatttgttgcaagatagccatgtactaataggtagaaacagaaatgactatgagaaccagatgttttgtctgggcctctgttgagaaacagggtttgcatgttggtatatataatttgtctcttgtttacccacactgattaaaggccatttatctagtggtgtgcacaattgctgtgtgcagtactcatttgcctgctcttaccactgtggtttctacacaacatgatatttctgttggcaatataaatttattacttcagaatggtcatattggaaatccaggatatgagcaatatttatttttatttaaaattactacgggggtttgttagacaatgccaagtttcctgacattggcaagaggccttacagagtttccccctaattttcgagggttgatttgtattacatgtacattttaacttgttattattgtaggattttatttgcttcaatttacaaaattctaggcttactttattttgtcttcacaagactctaaactcttctccttaggaatatccaaaagatattatttgtggttctgatcctagactgatttggtttgttttcagaatctaaaccacttaaggaaaagaaagaactgatgaaacagttttaattttattcttttttaatactgtgtagcctaatatgttgtggtacatttttcccataggttcatatccagctttcagagtggcaccgtgcaatttttcttccacaggcctggcttgcatacatgaatcgagcttatcatgccattttacaggtaatgaaaccacaggataggtttgctttggcgaaatgtctccttatctcatgttttgctacaaatgtgtatttaatataaaagcacttgggaaaatagcactaccaaaaatgtaatggttatttttactcataaaagaatgtgaggcatatatatatagcattgctgcacttaaacatcaatgccccccaaatccatgtgtcccatccagaactccctcttgagtgccagtctcctccatcctgctgccttctggacatcctcacttggctgccccacagcacctgacttgagtgcatcccaaactgagctcattgtcttccattatacctgtgcttcctcaagctggacttgcttacatctccagcctgatctcttaaaccttcccccatatttttatgtttcagtcttgttaaatttctttgttttcctaaactcagcatgtcttccctaacctcttagcttttaaacacactattctttctgtctctgaccctgccactccctctttacccacctaattttacttgttctttacccacctaatttctacttgttctctagatcaatttatctggtcaggcactatgtgccttacttctctccccactggattatatgcccttcttgtatctgagctttcctttttgaagcccttatcatgttagttatttggcgaggacttccagttgtctctgtactcctaaggacaggagctctgttgtctctggccctgacataagtgtctaaacgtactaggtgctcactaaatgaatgagatatactcaatttgagtttatttgatccaataatattataagttatagtttgtgaatttttaaatttagaaataattttaatcagttggggaatatacagttaacaatacaagaaaacaactagcttaattgtttttcgtagcttaaaattgattattaaggataataggagaaatccgatgttactgaagtaatttatgtcccagagtaagatttccgtgaaggcttaaaagtgaggtattgtggttagagataacagctgtcctataaaatgaggtgggcggggtgagagtggggcataggatggggtgagaggaatgactgtctgggcaatggtgttctaatctcaaattaaaacctttttacaacccatcttacagatcttagaactcgtaaaacactaatgtatcttcagagattctgatatattagaagtgaataggggaccaggaatctccatgttttacaagctgccaggtgatttaaatccacgtagtctaccagccaaacttagagcaaacagttttagaagatcccctaaatgtactgtaatctgcattttaaagatgttcctttggaaccatcgttttcttttgcttgttgtttccttactcaatttttatcttcagcagcatctgggcacccagcatgttttggataaatgcatgagtgaatgaatgaatgactcatgtctctatatttctttaagagccaattacagtttttagtcaggaaacataagattgcaagtcagagtatgtactttttctcacattcatttttccctaagcaatgttgaattttttcttcaccaaacatttatgtaacatgttttattggggaggtcccatgctaagtgtgtgggatactgagggcactccttcctcacaatgagctcccagtccactgggagaggctaacatgcccactagcaattccagtacagtatctttgatgcattaataaaggatgttcaaaatgctatgggcacctggagaaagggatgaagagctcctcctcctgcagaatgaactaagaattctatttagctcttagtgtaagaaaggctaaattgaatagggttatagtataattctgcagatgacttgcaattgattaaaaaaagccatgaatttttaaataagagctatggtttgttgagtaactagtgtgtgtccagtacttaacatatattatttcaattaatctatacagaaaccctttgaagtagatgttattaaccccatgtataatgggattatagatgggaaagcagggttagctaggaaagcaaagcaaacagctcaggaacccaacaagcactaaatgaaaatacaggaacttaacctgactccagagccttagcgttttccactgtgacatgtattttccctaacacggttattaattgttataatgaataatgcaaatttgtttaatattttaaagggcaaatctatttgatctatgaaaaacctgcagattattcataatttttagcaatgcaggtcaattattctgctattaaggtgatggttggtatctttatttatcatttaaaatccctttactttgtatttctagtaagtccagttccattgagaattggtgacaaaagaagagaaagtgaaaggatggattaaaataagatttgcagtattatttaaaaatacagcagtgtgatttaggctatcactattacttgaaagtacactgatgcatttatgcttaaacaagttttttaaatgagtccacacgcttaaatagagtttatggtatcttagaataattggagcaactgccagactccttgtctatatcaagaatttcggtcctagaagacactttttctgtacaggaattacagttacttccatctggtgctagatgtattttttagcattaaactagaggatcatttagaggtgccatgttttattcaattaagcctaggaaatgcactaaaaggtagattctccattacttcctggaggctaattaggatgtaagtctgagatctgaacactacttgtagcttctgcttagacgtctgcttcaagccttacctaatttttccataggaacttggggtttttaactataaatatatcaaagtggttgacatggggagaggtatttagatttcttcccattaagataaaaaatgcagatagaagccaactgacagtacagaggccattttggttaggagccgtctgcagtctttatcttgttacccttctgggatgctgtggaggttaaggtctccagcctttttgaaaagggctctttggaattgtgaatgtgacctcaaacaggagagaggtatgaaagcaaattgactgtagacatttttcatgaattggccagctagttgccaaataaccagaaatcagagcccagatcaggaactgcagcttccagtaagttactctatggcaatttataccttttttgctttttttgtgtgtgtatctttgttttgttttaaatgtgtaggaagctaggtgaaattgcttactataatcagcaagttcttatggtacaggctaaagattaaaaatcagaggggatagctagattaatcattggaatctacaggcaatccaaaaaaatctcaattcaggtgatcactttagccattttgctcccagtatgtgttttcccaaaaatgttaatcagaaagcagagatgactgagttgaatgctgctggatctctctattaccagtaagtcaagaattggaaggcgccatggatctgagtaaatagcccaacatagattgggtggcagggattaataagggagacattccagaaaagaggatagaaaagaacagagactcagagaaagaaaaaacatgaaaactacttagtcacaatagaatggtcgtgctgatttgtgactgcagggaagattaaaacggtaggccttcttaagaaggtgcatgtattctagttttcttgtgttttgtttatctttaaacggatttttaaaatttcttgttccttgtcttttttggaaaagcattataggaaatgttttaggagtaaggaggcataatttaagaagcataactgagacaggcaataaaaattgttttatactttgttttgcctggactcctgggaggccaatattaatatcttgctaatttccaagaaacaaaggggagaatgaaagggccagaattctatctttgaaagtatggagaatgaggattgatatgattgaagcaaatgaactatgaaggatgtgaatacagtgtccgttacatctcagagtgcctgaactggtgagccccagggtatggtgagtcgggagttgtgctaaatacacaaactctgtagatcgataaatagtccttgacctcacagggtgagcaactttgagaagtacaaggacatataactttatagtctggatattacatttttgggacctcttactccatgagattatacagataaaaatatgaattatttcaggagatatttagataaattcatgaaagacggttttgtaagaaaataagagggaggtagagatctttggttattgacaacaaatctaataacggtagctattatttgttatcaggcactatttaatgtgatgctttaataccacaagatatttgttggccactttttacaaatgaggaaactgaagcttagagaagtgaagtaacttgcctaaatttacacagccagtaggtgtaaatggcattaggccgaggcattctgagcccatgtccttaactcttcaatgtgtatcacttttctaagtatggagagatacatacttttcttctatacactatatcttagaactttaaaatcaataagaaaaagacagctagtagagaaatggacagaatagaaaaatcctgatagttaagaagatatgaaaagatcctcaatctcactagtaaacaatgaaataacattaaaaccatagtgaagaccatttcatatccaccaaaatggaaaaaattaaaagcctgacaattccgaatgctggtgagaatatgaagtaaccagaactcttgtttactgcttgtgatatgtaaactggcacatctacttctgataatggttgggcattacactgctgaattcttgtccaagttagggcccatcaacaaacagtattttaattatagataatttagataatgtaattggtgatggagtagagggggaagcatctgattaaaataattctgagtaaaaaaatggaaaagataatacatatttaaaggccttggacttaaaggaacaatgttagcaatattttttttcacatgctagaatttgggaattatggtacctatttttataagttcactcaagaaatagaagtgtaatgtagagctgttggagaataacttatattatatcttaccggaatcttaagtgttacatactttagcttgttttctagttttctattataatactggtgtatggtccccaatcttggtatattttggtgttagctaaaattatcagttgctaacaaaggcagatcactagcaggtagattttttaaatggggtctctgaaattcaaatttgattcagtaggtatctcaaaattaaattctctgcactaaatttgccaaacatacaacttctctaggatgttacctctttggtgaatgtagaaatacctgagcattgatgtgatgatttctcctcacacatcctctttcataatctaatgtcttacccagaacacttaaggccaaatggaaaaggatatatctgtgttttccaaagaaattttaagatcacttcagccatcgagttcacatgctgatttatgctgtgatttttgcagggaagactaggagagctggagttgcagttaaaacatggaaaagaagaacctgaggaggtgcagtacaaaaaaagcacagcctggctctggtaagtgttcatgttcagctgcccattatttgtcatgggaagtgagctatgaggggaaaggtaactactttaaaggctttaagattagcaggtttaacctctatatgtgagcctgaaggggaaatgacagaagagctgataggtgtattccctagataggagatagagagctttatttataaattatacatacacacacacacacacacacacacacacacacacacacacacacgttctaaaacaatgtggaaacagtttgctttttcccttttctacctgtaactgattattttatatgcttttgaatgaaaaattctttttttcccactctgttcattgctttcctacctcacatgtagtcaaggattacttctcccctcctctgctcccctcttccccaagacataattattaggagcaactttaccgtgtcatgggtttaatttctttggcagacatttcccagggaattcccactatatcatctagaaatatattagtgctggctcataaaagcaacttaaactgtttcatgggttgagaagaatactctatcagatttgtgtttcaccagcctaaatgtaagtaaagtgcctaaagtctaaatagctttgcctacaaccacaggttgctttaatctaaaaatctgtccgaagattatttaattataggttttcatttactgacagttggctcatgtagaaaaggagaaactgtgtgtatgtatttgattaattgtattctaagtcatattttctagatttatcaaaaaatggcaatgaagtttaaaacattatgatattggatttaggattagagggttttgtatcctatttgctcttatcttttgcatctattttaaatttaatcatctgaaagtgataattggtgaagtagtatatttgctaagttctttaaaatatatagagagacctatcaatacatattcctagtgaaaactcatgggctgtgtatatatgagtataaaggagttaggtccctagaagtttcttaagaatgatttcggctggatgtggtggttcatgcctgtaatcccagcactttgggaggccaaggcaggtggatcatttgagcccaagagttcaaggccagcttgggcaacatggcaaaactctgtctttccaaaaaaaaaaaaaagatacagttaaacctgcagtaactaataagctaccttgaagtgagctcttcctcatcctcacttaattggaacacaatcccaaatctaagtaaagtcatcacttgatttattatttcaaaaagtatttattgagtgtctgtcatgtgccaggcactgttctaagcacagaggaacagcagtgaataaagccccttctttgtccctccaaagcttatacttgagtagatggaaacctgtaataaacaaataaacaaatggaatatgatagaagttgattcatggaagaaaaataaagtacgatagagggaacagagagtgaatgaggcttgagggaggttgaggggtggcattaccattttctgtacggtgttcagggtctctttaataatatgacatttgaatgagacctgaaggaagtggtggagtgagccaagctgatatctggagaagagcattctaggaagaggaaacagcgaattcatcataggccctgggagtgtacctggcaaagcctgtgtggcatggagagcgcaaggatggaagtagtggacatgagagtagagaagttcgggagattgcagggtggagagtctttgtcagcacaaagaggactttgtgagtgagatggagaaacattggcagatcttaatcacagaatctgactcatgatttaaaaggaccactccagctgttatgttgaaaatacaccctgcggggcatggttaggagtccgttgcaataatttaggcaagagataatagtgttttagactaggatgttagtgtggaaaagtaaattgattttgaatctattttaaggcagatatcatacgttataaatgctaataattgaaatgaaggatgtgaaagaaagggatcaatcaaagatactccaagattttaactctaaacaaaagtatggcatttccatttaagacaaggaagactagagaaaagcaggtctgcgtagaataggaatcagattttggacttaggcctgagatgcctcattagcctccaattagagatagcaagcaggttgttgactagtctatagttccagggagagctcagagctagagaggtgaatttaggaaacatcagcatattgatggcatttaaaatcatgatgctggatgaggtcacttagggagtgaataaagaaagagaagatttcaaaagattgagccctgattctatatttaaaggtggggaagatgaagagggaaccaataaagcagacgaaaaattagttatcagtgacgtagaaagagaaccaaaagagagtaaaatcttaaaagccaaggaaagaaggcattctaaggagcaaccaactgtgtcaaatactgttgttaggctgcagaagatagggactgagaattgagcattagattcagtctcttgaaaataattggtggtcatgacaggagctcttttggtagagttattgagacaaaagccaggttctagaaggatctagagagagtggaaggaaataacgagagtcatcaagcataatcttttacacaagttttgacgtataacagaccaagaaatggggcaatagctggtgggcttgttctgctttcttcttttagagggtagatactacagtatgttcacatgctaagggaaataatacaagtagagatggaaaaatttgtgatgcagcagagaggagggagtagagaggtagctttagtgcacaagtggaaggtttgaccttaaatgtaagtatacataggtcatcatttgtaaatattccacactgaccaatgaaatattacattgaatggactatattccatttaggaatacggaaattaaacagtacattttagagaaatttgcagtcaaatgcttttaaaaaatacaagattgagatctataggaggtgttgcacctgtctgaaaaacttgtctcttaagagtgactcattctcagagtgctgaatagctaagattttattatatatcaaatgcaaatatttatgaatgtcaatataatttatatttaaatgcaacaactttaacaatatttataaaaccttcgaatttataaaattcaatgtttatattgaaaatgatccttttaaaaaagtaaatttgacagcaagtggttgttttttacttcatattgaaaattctatattgaattaaaaattaggttctgtaaatatttgaattgtgcctaccttctttctaacccacaagtataattattttcttttggctttcctgtgactatataaccaaagtttgaaattgcattttctataaacacatagcgactatttcatatgtacaatttgaaaattgtaaattgatgttttggtgagctctcatgtaaaaaagagagactgtcttagtcagtttgggcttctaaatgccaccacattggggattaggattcaatttcaaatgtgaatttggtggggtatgcaaacattcagtccattgaagagagtaatataatggacacttgtatactcaccacgctgtctgagataatactgttacagtgctatctgtacatcccccctcagttacatattcacctcctccttgcctccactcagtgaccttatgaacaggaagatgaagctatctgtaaagcagagcccttattacagttctttcaccttatactgaaattctacctgtatagttttaagatctggagccattgctggaggttcttattaattgatgaaaaagagaaaggaatgatttcttgttctaacataaactctcgtctattttccatctttattgcagggttagagacatgctgactgatgagatcaccaaggcagctgcaaagtaagatccatttagtcttttatcaaacattttttataaataccttttcctggcaggtacatacattttctccttttagggcatttcataattttaaggattttagagtacttttcaattatttttttaaaaaattaatcgttacccttcttatagtaggtgaattcttactacatgtctttttgtgaaaatacagaaggattggtactaacatataacttttacatcaggagtcactgaagttgagcccctgctgtatacctaacagatgacatgtgctttggcttaaacttaaaggattgtaatttagttcgaggggattaaaaaaaaaaagaaaggaatccttgctaatatgagttatgttggtagtacttccttttgttccattggtgttattgggttccgcatatctaaaaattgaatttttaaatactaaaaactaatgccaaggcccatttaaaaagcagttttagtcatatgcttatggttgttttaacaaaaattacttgagtgtcactgccttgatgctttttatttaccttaagccagctctcactaaaaaatacccgaaacttgcttgaacaatctcttcaggttcctttgtcaactgacaagctgactaattgttcctggcagtaagttacatgccagttacactcccttccaccatcttctctaactgctgccatttctgtttgactcctttctttcttgcctccaaccaacacagatatacctttgacctagaggatttcatgtgtattaaaagtccatatcatccagaaatttttaattgtagtatagtttatccttttcatgtcacaaaaccttctgtagctaaatagattttgccttaaaaacagaacaaaaaatgatctaccttagagttagctttctatcaataatttcttaaacagacacttaactgtgaagtctgatctcagcagattatcactgttcagtctcatgtcttctggataaagagaaatagaagtgataatcctcccctgactcagtcctatggaaggcactgggaaatatctgttgataaaatgaaaactaaagtacagagagcttagatggagactcattcttgtcttgttttcccactttggtgaattgcagacatagtgggagagggctcagttgcatatcagagggggaggggatgctgggatgagaatgcaggctgtctttgacctttacctgtaatagtttgttctcttatgtagtctacatatatcctattaaaagcagtgctctgacatttgctgcaaaaacttgaatgcagaagaaactaccaactttctcctaaagcaaattataattcctcgtgtctagtagatattgcaattttccattctaaaattttactccagtgtgactgtaattttcatattcacaaagtatcacttcgtgactaatacctaaagaaaatatgtttacatgagtaaaactaattcatgttctcatggtattaccttctcatcaaaacttacaaagtggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtaatggcgggcgcctgtagtcccagctacttgggaggctgaggcaggagaatggcgtgaacccgggaggcggagcttgcagtgagcagagatcccgccactgcactccagcctgggtgacagagcgagactccgtctcaaaaaaaaaaaaaaaacttacaaagtatcttatagaccttattttaataaagcaatcttgacaatactaggaatggtagcaagtgtataagagatattttaggtctggaggctgagagattggtgatagagcaggggaaaaaatcattctgtcaccctctctgcttcttcccactggcttcctccaacatgaggccttcaccactgcccgctgccagcttagcttccctttccttagctacggctgccacaggctggtttgggtcagggtatggcttgttttgttcagagctagaagttaaatgcaaaaagtgacataccaatcatgggatgatcctgatttgttcatgtaagcccaaaatctcctcaagctgataagcaacttcagcaaagtctcaggatacaaaatcaatgtgcaaaaatcgcaagcattcttatacaccaataacagacaaacagagagccacatcatgagtgaactcccattcacaattgcttcaaagagaataaaatacctaggaatccaacttacaagggacgtgaaggacctcttcaaggagaactacggaccactgctgaatgaaataaaagacgatacaaacaaatggaagaacattccatgttcctgggtaggaagaatcaatatcgtgaaaatggccatactgcccaaggtaatttatagattcaatgccatccccatcaagctaccaatgactttcttcacaggattggaaaaaactactttaaagttcatatggaaccaaaaagcccacatcaccaagtcaatcctaagccaaaagaacaaagcaggaggcatcatgctacctgacttcaaactatactacaaggctacagtaaccaaaacagcatggaactggtaccaaaacagagatatacaccaacggaacagaacagagctctcagaaataacaccgcatatctacaactatctgatctttgacaaacctgagaaaaacaagcaatggggaaaggattccctatttcataaatggtgctgggaaaactggctagccatatgtagaaagctgaaactggatcccttccttacaccttatacgaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttcagcacagcaaaagaaactaccatcagagtgaacaggcaacctacaaaatgggagaaaattttctcaacctactcatctgacaaagggctaatatccagaatctacaatgaactcaaacaaattcacaagaaaaaaacagacaaccccatcaacaagtgggcgaaggagatgaacagacacttctcagaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaaggtcaaaaaactgaacaccgcatgttcttactcataggtgggaattgaacaatgagaacacatggacacaggaaagggaacatcacactctggggactgttgtggggtggggggagtggggagggatagcattaggagatatacctaatgctaaatgacgagttagtgggtgcagcacaccagcatggcacatgtatacatatgtaactaacctgcacattgtgcacatgtaccctaaaacttaaagtataataataataaaattaaaaaataaataaataaataaataaatgaaggtgaaaacaaaaaaaagtcgagtcaataaaaatttagcaaattttcacatccaaaaaaataaaaaagaacatttaaagcttcagggataggggtaagggagagtcagaacacgtataaaacctgatgattgatgtgaatttatttcccttattatttattaaacagatttaaacctgaagataaaaatcactgaagtattgagtcactttactaatatgtaatgtaatactttgtccctaagaaagcatcattgtagctcagccttccttgtgctttttaattaggttaataacatcattttgttttaaaggacaatttaattaaaacgtcggtggtgttgcctagataaatactctgtggaagctgacatgttattatgcaaattagtctctcttgtttgactggtaggggatagttatttgagcaacaaggtgatgagtttttactgaaccagttatagattcccacctctccagctcctccttgaatttgtttcacttagtatgtattgagtaccttctatccataagtcattgtggcaggcatgaagggaatgcgaagatgatcaagagttagtcatggtacctttgtgaaatgtgtaatttggcctagggctgcactgtatagagtggactaggtttttaattcaaagattattatccaaatatgtgttcattctgcaaccaaatatattattaccagtgtttttaaataaatttttctccattacttaagaacaatacatactcagatatgtcaagactagtgaaggatttgaaataaaatagtttttggtactgttttaaaaccgaggctaatttctctttcagaattttggggttaaaaagaactttttatgttatcttgtctaatatatttgttttatgacttttgatacccagattctagtgacctcacgttttctacagagtaataaaactgggactctaatactcagatcactcaaaatttagaactgtttttaaaactcacctttagggattcatgaccattttgcagtaggaaaggcctcaggatattctgttaaaagaaagagataatattagaaataaaagatttaattttgtttttgttaaatgattttatggctagggcacctaggaatgaccaaatcccaccttgtttccttgtgttttcttattagctatatgagtgctctgtaattctctttgtagaactctagcaaaacccaggttggggccatctgcttagacctcaaggcttccttcccattttctcctccaaccctccccattataaacgttgatgtcttgctaacttttgacaggccttatagaggaatacattgaggtgggggggtggtggtgaacaaaatgatcaaggcttcaagtcttcacagagcttaaccactctaaagtggaagggagagggggaaggaaggatgggcgaatagataggaaggatttgttaatggcaagtcctgagtcccattcttaccaaatgaaagcagaaatgcaagaacacatgtgcgccagcaatttaatacccactgactcaagtcttcaattgagactatggcttgggacttgaggtactaggctcatttagggagcagagctgaaaatcttccttatccctcatatctgttatagtcctgccctgaggtaagcaggaagtggttcttggatcatgcactgaattcagattcgggtttgaagtccaaattttggggaacattgtatttatgggaacccacatcaaaggactgaggactaaacgatctgatggtatgggtgctcttgttgctggagttctgttataaacgaattggcaaacctagagcatctgattggtgtcccataggggactttataggatcagcttggaattatggaataatattaaatgtacattttcaagtggtaagtatattaaaaaggttcaggtttttacgttaaattcagaagtcaaactcttaagagtttattgctgatattagaaggctaccatttagatgatgtaaaaaggcaactttcagtccaaatagtctaaaaacagccctttttcatttgcatcttatctggggtctccaaattatattacaaactgggtttaaggttgatagttttgctatattaagagaaagaaggagaggataaaaatgagtaagaaaagctgctgtgtgtcaagttgtaaggtatgcaggctgaagtggtttgctagaagccagttcaacataccggtgcttcagaaaagccaaagattgttctattctgctgggcttattgacataactgtcttagttatgtctttacaacaaatcaataattttaaattggccaaagatgacacagaagagatcctaggaaatgtaatgttaatagatgaaataaaaatttaggaagaaacaacttactaagcttggatttttaagttatgaaaaggcataatgacccatactacattgataagaagaattcagaaacagctctagagtcagaaggaaggaaagaaactgttggcctaacacaacaaacagacctgcatttacaagactctgtgaaggaacacaagttgctttttgacttcacctgccctcctatattagctctttctcttcttctggttaataccaaagttctctgttgaaatttttttccttttgaacagggagagtccggtagtgaaaggcaatgcgctgttagctctaagcagccttgctgtcgtcgtatctagacatgaagccagcctctcctcagactctgacgggctcctggaggttagttggggtgatttaaacaattggctttgattatgtctttttaagcctggctttaggtagcctggccctgggcttacaaggttagattctgtgattatggcaccaagttatagtacttgatgggcctttatactgtgagcctcagtgtcttcctaactttgctgcttttctgttttcctttctccatcacagttaagtggtcatttctatttgaaggtgccaattttatgccataggggttatctttttgtgattacatcaatggtaaccaatcttacaaggttaactaggcttactgaaagtgaacaatgccgtcaaaatgataaataagcagtgtttattgactgaaaaaaatgtactttgcattttaattgtatatgtcaatgacaaagtgcctattcatttttgcaaggcagttatttcttaattaaacatgtggtgagctggccactgttcatttctaatgtactttcttggataattcatatctgtctaaataaaaaggcatggatttattcttgttttaagtctcattatctggtagctgtcatcatctagagatgacataactgagtcgttaaaaatataggctttggaataagaaagtcctatatttagatcctattacttccacttactacctctatggcctatttgtagcaatttcctctttcagaacctatttctccatctgtaaaatggagggataacaatgctcaccagataggattgttcgaaggattaaatgaattaatatatgtgaagcacaacagctcatagatactaagctcttattaataataaccattcaaaattattcagtctgtctctgtcctcaatgagtatcttatgggctatctgtattctttttttgttgttgtgggttttttggtggtacactaaaaaaatcaactctggtgactcatttaaaccaaaaaggaacaggaagtatatggaatctagaagcccgtggaattaaaggcaaagcttaaaaactgtattttgggaagaacaagaaccagggcaagttgggtagtccaggcaacaggtactaatgaaacatctaagcagaccacctccagtgggccagaacaacttcagtcatttattatcctcatgtcacttaaaattcagagtcctttgggtcctaggcctaccccttggacagtgtaggacagctagtttgattgagcatttaactaaccttcaaacagtggggaagacggaactctgcaaagggtgttactaccagtaaacagagaataggtgctgtgtggcaaaagccatggatatatattacatgtagggaagggaaagaggccaagggattattgcatgaatgatattagttaattaccttatgaaaatttaattttaaacttagaatcttaccgataagaaagatggaaattttatagagaggaaatgtttcatgtctttcagagagccatggaatattttagcagaggcaacatgctgcatagatctacaacctaaaatgtcaatgcccctttctatgatcccttcactttggtgttatttttgttgaactaccagttatacagtaattttccccaataataaaggggtctagctcagagtttgagttccagcctctcttactttctcctccaccccaacacaccccaacacacattgagaaaccacacagtccaaagatgaggctttgcttttattcatgatgaccttgcctttggctgttactcaatgcaaattcaagacctcattatttgattaaagttgaaactttcaaacattattcaaacctgcatgtgaccaccaacaaaagatttgaagatgtgacagccttgtttggttcaaggaattacaataattccagttaccatgtgagttaatgaatgcttttgacatccatggtcatgaatgactttaataaccaagttttatttttaatgagtggggttttttttgttgttttgtttttgtgttctcttcctcttctttttcaaactgaagatgattcatgttttctacctaatctttcagtgagttgggtgaatgttgtcaagattcttgaaatgacaactaaatggtaatagtcaccagaaatgctagagatgttgatctgaattctgtgggctgcttattgcctcctttgtcaaataagaagtcatagaaatgagaaattttgaattatgttttttgcacatctgtccttttaacctccatattatcttcactataattcattcaacgcaggagagctctgaagggctcttggatagttctgttttgcagcatctatcctcttctgctaatttgttcataaaagatacatcttatttcttttggggcacaggtgaggatgtatatttgtcaactacctgtatacctcatacgtgcatgcttatagtccaagcagatgaagtttactttttgataacagcactttattgtttaatatagaagggagttacaccttagatttagaaatatctttagatttgttttctctgtaatcatttcatgtttttaattcatctgcaggttcaacctaatttcctttcaatgaaagagtgggtttccatggtacttgatacactcttggtcattgtggatagccattaccaacccagagggcaacttctctcctggttttattatgtaagtgcaaaaaataaaaaatgatcagaaaactcaagaattgactcttatgacatcagttggtcacatgaaatcgattatataggccaggcgcggtggctcacgcctgtaatcccagcactttggaagtctgaggtgggcggatcacctgaggttgggagttcgagaccagcctgaccaacatggagaaaccgcatctctactaaaaacacaaaattagccgggcgtggtggcacatgcctgtaatcccagctactcaggaggctgaggcaggagaatcactttaacccgggaggcagaggtaatggtgagccaagatcgcgccattgcactgcagcctaggcaacaagagaaaaactgtgtctcaaaaaaaaaaaaaagaaaaagaaaaaaaaaagaaatccattatatagtgtaatgattctcagccctggctatttgttagaatcacctggggaactttaaatacacacacacacgaaatattatctatataaaatatgaaaatattatatatgtaaattataagaaatatgtgtgtaaatattaatgttatatatgtacgtacatatgcatatataatgtgaaatatatatgtatagacatatatatatatatataaaagaaataccaatgtgtagtccccactgctgatttaattgctcatggataaactccgggcatcagtattttgagagctctctcagttattctaatgtgtagtcagggtcaagagctacagttgtagtagaataaacattggctgaaatgtggggactccaagtttctagtcatagatttttttcatttcagattgtgtgactttgggcaattcactcaacctctttgagtctttttgtcctgatttataaaatgaaggaattgaaaaatatcatctatagtagttgtagcccttgctccccacttcttgtttttgtgactgttgacacttacttcatcattcttatttttcttatctgcaaaatgaaagtaaaaattaatgctttgccaactttctaaaaagattgtgaagatcaaataatatactttatgtaaaaagttttgaaaactgttaaatactctataaatacaaagtaatgttgttgatcatttaaaaaaaaaagccacctgttacccatcctctgtcttcatgcttgtattctaagatttgaagcaaaatgagaaaacacttttttgttttggtttccttttccttttattggtcgtagtacatgctttatttctgtgtctttgtagaagtattttggtcctaccctattactatccattgcctagggaattataatggtcatgggacaatcagctgagtggcagaggattatagttaattttaataaaaatataacacagattctgaactgttgctaagatcatgaatttagcttaaaaccttaatgccgaaggtcttctctgtgtattttgtgtgcctctgtcctgcccttgggaagatctggtatgtattcatcaggggctttgggtttagagctagatttttaaccatagttgaggtaaaaaaaaaaaaaatgacttaccagatgatgtagaattaaattggaagataaattttgctcaaaaagttaattgctctatgatgatttactttctgtcagaagtgttcttatttctttaatgatgaatgaaaactttagatgcttatggaggtctttgcaataactatctagttcaggtattcaccagagcaggacactgtatgaaatttctcatatgctgcttagttcttgcaaaccaataaaaataatctctttactagtcagctctgattgtctcttacctttgtgaggttttgcattaccatacttttcaaagccctgttttaaaagtcactttatttcatgtgtgctaccagctggatcattttgagtaacattatcattaaaacagtgctatattaatttaaagtgtaacttagtacgtttgatttttatccttaaagtactaaagcttagagagcgaatgggcctagaattaaaaacatattttaatgtgctttaactgcaagggacaacactgcccttatggtgtgtctgaaactttaaattggataatagtgaggaatgataaacgggctttctttcccacttgagacatatttataaatgtatataacgtctggtagagctctctaacctgggattcttatagaagctgttcatattcagctgctctgtcattttattagggctgttattcatttcttttcccataattacatgtaggaaggggcatatagagctctccatttcattttgaatagctggttattgctttgtaaccaaaggcttttaggatttcaacttcctttttaattaaaaggaattaaccccctgtaggaaataatccatctactgggaagtgttcccaccaaaaattttgggagatgtgccaatagatccctgtgctaaatttatacttgcttctccatactaaacttaaactctcttcctcccttttcctttcttccctggaaaactcctagctttctggacatttataatgtggcttgctggtttgtccaagctcagatagcttcagttttttttttgtttgtttttctgtttttttgtttttttaatatatatacatgtgggcttttaggaacactgaaattgtttcaagccttatagtgagggaatttataacctttaaaaggaagacgcttgtaatttggtttttcagatttaaaaggatattattaattatttagtagcaaaacatttcattaataatgaaaacataatctatagacaaaaacgtttggatttttaaaaaatgtattattttgggtgtcggccggggtggatctaagagaagcttgtgtggttgtatagtgcttttatgataggtatgcttccttcatgtttaaggctaaccctgttttctttctttggcatgtcctagaagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcaggtacagtttattaaaatattcctgcttttcttctttgtgattttttgcaaaggattttgcacccatatgcacctatatataaacattgtatctgagcaatatgtgtttgctaaactttctgagatgggcaagttgatcctttattcttctttaggagtaaatttatctatctaaaataccatcgtgtaggtattaatgtattttaagggttgctagtattaaagtgtttggttacttgaaaatcatttcatgcttagatgaaagccccaggtacctatgtgtggtggacatgagaaaagtcaagttatggtgctataagtaaaaagcttcttttttctggtttgtatgggatgaaaataactgccaatcttttgttgatatcattgaaaatgagaggagaggattggcatatctctagtgcctaaggggtgttgggaatcactgaattacctgagaactacatgtacccggctttaaatattgctttttttcctgtgccctggccacatttttataatccttaaagagtcttaatctgtgcatattatactgtgtgctttgttcactttgattgctcatttttggactgctaactttatttacccttgaatggagctaatggaatagactcaggtggaaaattccactaaatcggaaaggtttttttagtgcatcagtctgctttagttttgttgttcatactgcttattatttattttctagcaattcttagaattttatatatctacattgattgtagtgggctacaatatgaatacttgcttatcatgaatattttgatgtcaatgactaggcatttagccctgttttcctactttggaaatatgatagtagggagaggcattctgttgtgatattagattcttttaaattcctggttggcagaaattagttgtccaaaggcaagaactggtgttggtgtggataaactggatgacactatgctatatttatttcagtttgagaccactgattaagttcttcacaaacacaagtatgtgaaacttttatgtgaattgctattgattttggggaataccatatttcagatgatcattttcagctcttagaaacatctgtcagatgattgggattattctcttagtctttgagaccataagtgcaatatggccagaatattcatttcgtcctgttcaccatcactaataaatataggtcttgttctggagatgaataaaaaactgccctttgcatgtgatttgactgttacatatcttgtgtgtgtgacagaacacaaactatttttaaagacttaaaacttgaaagtgattttttccctttgctactatgctacaaatgacagtctctccaccatctgtgttcatgctctttctttggtatcttttcaagcaacatgttttgcaactaaaaatgagccgtagcagtttaattctaggcaactcatttcatcctattctggctctgactcctttcttcactaacttaggaggagatgctgctgcttttaggctgacaagcttgcatttgtggttaacttaatcatgctgcctggagaaacctatgatgattcccccagaacacttgaccctgcttcctaggttgtcttccattcctgtctgtctgacttgaattcacacctgaaggaaaccctgggcaaagacatcaggaagctccttccttagctgagcacccacagaataactacagattttaactttgccctaacgttcctgtgtttgatagcatcctccttctacttagggcctgtgtgttagtaatgccattactaacataactattcatggctcccaccttcccaatttgttggaattgaggaatctcaaatatttgccttttgatactaataaattttttaccaggtagtaacaatgctaacagagaatttcatctttggagaaagtttaaatttttttctaaaagcaagtgttttgagagctgttgattttgactagtcagtgacatcaaatgtgtcccaatgtggtcctttaatgggaacagaattaggacaatatgttgtttttcagagactaagaaatcaccatgtagaagagaattatgaatcacatctgtaattgcagcattttgggaggccaaggcgggcagatcatgtaagcccaggagtttgagaccagccaggcatggtggcagatgcctgtagtcccagctactcgggaagctgaggcttgagaattgcttgagcccaggaggctgaggttgcagtgagctgatgttgtgccactgcactccagcccagcctgggtgagaatgcaagactctatctcaaaaaaaaaaaaaaaaagggggggagaattatgaaaatcatttcaatttttgctaaggcttatgaaaaagtctcctgaatttaagttccatctaaaatttattcagaagctgtggaatgttgttccacagcttcttgcttctgtcataacccccagaaaatacaaaaatgatctctttaacatttgtttaggatatttaagtatattttactccaaaggacaacttttataggatttatttagttaaagctattaagtctgtgtgtgtgatatgaggggtgtgcgtgtgggcatttgtttttcattgcaaaaattccttcaccttgggcaaaactgctatagtcttggtttgggaaaatgtttaaaaaagtgctctctgcctggttgtcattcctggagttacattccacttaccatgatctgaagtagcaatatgagagttaagacgtaggaacctgtagctactaaaatgtcagtgatgaagcccacaaatctgcctggagggacaaccatagaaccttttaagttttattttactatgcaagtcatacttctcacccaggcatttataaaatcatcaattgctgtataaatgtaaacaaatataggtctaggattttctccccttaaaaaaaagtaagtaaaggaatagaatttataacctccacaactgagacatgaaatcagaagtgacagtctttgcaagaaagatttggaatgattattgataatgtcaggttaatacgttaagtattctgaagaaaatcacttaagcatccttagaaatatatatttggaattccgagtttcttttttatttttcaatggcttaaaatttgaacaggctaagaaaaatcaaaaataggagattttgtgtttattggtttgcaagtgattatactgctcagaaatccaattattgaataattggtcagacttagtttctgtaactaccaaataagaataggcaactcatcaatattgtcacttttttttttaagagaaatgctggtatttccagtaaaatattgagagtataatattgtattcagtattttggatagttgactaattttaaataattcattgtttccccttgatctttaaccagtgatatatctggccaagagatgaaccttcttctgatgaagtcgttggatgccctggaaaattgctgctttgacactagtcttgaatacaagtatgttgttcctatttccactctcacaggtacttagacattgctccctacactgccataagtcttgcatgctatggagaaatattttttatttttattttttatttccataggttattggggaacaggtggtgtttggttacatgagtaagttctttagtggtgatttgtgagattttggtgcccccatcacccaagcagtatacactgcacacaatttgtcatcttttgtccctcaccctcttcccacgctttctccctgaatccccaaagtccagtgtgtgattcttaagcctttgtatcctcatagcttagctcccacttatgagtgagaatatatgacgtttggtttttccattcctgagttacttcacttagaataatagtctccagtctcatccagattgctgtgaatgccattagttcattcctttttatggctgagtagtattccatcgtgtgtgtgtatgtgtgtgtgtgtgtgtatcacagtttctttatccactcattgattgatgggtatttgagttggttccacgtttttgcaattgtgaattgtgctgctataaacatgcatgtgaaagtacttttttgtataatgacttcttttcctgtgagtacatacccagtagtgggattgctggatcaaatggtggttctacttttagttgtttaaggaatctccacactgttttccatagtgattgtactagtttacactcccactagcagtgtagaagtgttctctgttcaccgcgtccacaccaacatctattttttttttattatggccattcttgcgggagtgaggtggtattgcattgtggttttgatttgcatttctctgatcattagtgatgttgagcatttttttatacatttgttggtcatttgtatatcttcttttgagaattgtctattcatgtccttagcccacttttggtgggattgtttgtttttgtcttgctaatttgtttgagtttgttgtagattctggatattagtcctttgtcagttgtatatagattgtgaagattttcgcccactctgtgggttgtctgtttactctgctgactgttgcttttgccatgcaaaagctctttcgtttaattaagtccaagctatttatcgtttttaactgcatttgctttttggttcttcatcatgaaatccttgtctaagccaatgtctagaagggtttttccagtgttatttttagaatttttatagttttaggtcttagatttaagtccttgagccatcttgagttgatttttggataaggtgagagctgaggatccttctgtacagttttattctcttacatgtagcttgccaattaagcttacatgtatcttaccagttacccccagcaccatttgttgagtagggtgtcctttacccacttgatgtttttttttctttgatttgttgaagatccgttggctgtatttgggtttatttctgggttatctattctgttccgttgttctatgtgcctagttttataccagtaccatgctgttttggtgaatgtggccttatagtatagtttgaaatcaggtaatgtgatgcctccagatttgttctttttgcctagtcttgctttggctatgtggacttcttcagaaagctcccagaattgataacagaattcagcaaagtttctggacacaaaattaatgtacccacatcagtagctcttctatataccaacagtgaccaagctgagaatcaaatcaagaaccccaccccttttttttacaatagctgcaaaaaaaaataataagatacttaggaatatacctaaccaaggaggtgaaagacctctgcaaggaaaactacaaaacactgctgaaagaaatcatagatgacacaaatggaaacacatcccatgctcatagatgggtagaatcaatattgtgataattaccatagtgtcaaaagcagtctacacattcagtgcagttctcatcaaaatactaccatcattctacacagaactagataaaacaatcttaaaattcatatggagaaatatttgtagaatgtgattttgaattcctttgcagagagttttcagtaataattaatcaaaaaacttattattaaagctttcttgttctgaaaaccaggtttcagcaatagacaaattatttaaattcaaagcaacaactatcatcttgcagcttacaccttatattactaagaccttagttttgacttacgtttatcatacaaggcacatgtatggggacatggatgcatgacttaatctttttttaaagtatttatttttatttatgtatttatttagacataatctcactcttattgcctaggctggagtgcaatggtggaatcttggctcactgcaacctccgcctcccgagttcaagtgattctcctgcctcagcctcccaaattgctggcattacaggcatacatcaccacgcccagctaattttgtatttttagtagagatggggtttcaccaattggtcaggctggtctcaaactcctgacctcatgtgatccacctgcttctgcctcccaaagtgctgggattacaggcgtgagccaccctgcccagccgacttaatctttttaaagatttgttgaggccatttgaatttgattgggctaagagggcctttgaccgatgatttatgtttccctgtgaaatcatgtgcctaagaagtagaaatggaagcaaacaggttatatcagggattaccaacctgcttagcattaagaacctttcccttccccatgctaaccccatggtttttaagttttgtctattaaactaaatgctttaaaattattttctcatttcattaatgaaagataaaaatgaaaaataatcaaaaaaagaattaaacacactcattttatgagatatttaatgtttcagttagtctgtgtgacttgtgtaggtgaatatatggtatggttttgttaggctttcggaaatactgacatttttgagggagcaacatcgtagttttttagacttccatgcgttttggaacgtcaggcatgaatcctctggtgttcattgttactaggaattaacagattataagcactaacttccagtttattgactcatttaccctttgatattatgggcactgctcaaatatgcattaaatcagtgtttacatttctggcctttaggaacttatgatttacagctacattcatactttctatcttgttagtttcagactaacaaaagggtaaatgatatggtagtggtagctgcatgtgtaaagggtttcatcaggaataaataaagtaaaatgtccatttaataggtggtagttatgggatcttctttcagatgcaggctgagattggagaggaactagtgccactcacctggtttctcaagaaacacttttggggtcaagtgacttcttaagagtgtggtttgaggccgggcgcggtggctcacgcctgtaatcccaggactttgggaggccgaggcaggtggatcacgaggtcaggagatcgagactgtcctggttaacacggtgaaaccctgtctctactaaaaatacaaaaaaaacagggatgccctctctcaccaccccgattcaacatagtgttggaagttctgaccagggcaatcaggcaggagaaggaaacaaaattaggaaaagaggaaatcaaattgtccctgtttgtagatggcatgattgtatatctagaaaaccccatcgtgtcagcccaaaatctccttaagctcataggcaacttcagcaaagtctcagaatacaaaatcaatgtgcaaaaatcacaaacatttttatacatcaataacagacaaacaaagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggagcagaacagagctctcagaaataatgccacatatctacaaccatctgatctttgacaaagctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagacgaaaacctagacaataccattcaggacataggcatgggcaaggactgcatgtctaaaacaccaaaagcaatgtcaagaaaggccaaaattgacaaatgggatctaattaaactaaagagcttctgcacagcaaaagaaactaccatcagagtgaacaggcaacctacagaatgggagagaatttttgcaatctactcatctgacaaaaggctaatatccagaatctacaatgaactcaaacaaattcacaagaaaaaaacagacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggaccgtaaactagttcaaccgttgtggaagtcagtgtggcgattcctcagggatctggaactagaaataccatttgacccagccattccattactgggtatatacccaaaggtttataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatatcctttgtagggacatggatgaagctggaaaccatcattctcagcaaactgtcgcaaggacaaaaaccaaacaccacatgttctcactcataggtgggaattgaacaatgagaacacatggacacaggaagcggaacatcacacacgggggcctgttgtggggtggggggagtggggagggatagcattaggggatatacctaatgttaaatgacaagttaatgggtacagcacaccaatatggcacctgtatacatatgtagctaacctgcacattgtgcacatgtaccctaaaacttataataaagaaaagaaaagaaagattgtagatatattaaaaaaagattatcttaccaatttttaagaattcattatatattatgtacatgaactttagtctaccatatttattacaaatatttttctcagtcattttgctgatttactttttaaaaagaatataaatgtattattaccactgaactgtacccttaaaaatgataaagatggtacttttatatgtatattttaccttaataaaaattaaattaaaaattgaaaaaaaaatacagaaaaaaaattagcagggcgtggttgcaggcgcctgtagtcccagctactcaggaggctgaggcagtagtatggtgtgaacccgggaggcggagcttgcagtgagccgagatcgtgccactgcactccagcctgggcgacagagcgagactctcttctcaaaaaaaaaaaaaaaaagagtgtggtttgaatatgagtaaagaaagagtttgatggcatggttgaagtatcttgaaaatagaaaatgattaatgagaaaaatagggaaatttagctgttatttgaatccaatgaagagttgagattttgaacctaatccatgcatttatattgccttttacaacctaggaataagatattttcatgtctctttccatccctcctgcctcctcttaccacccaaagatgttcattgtagcttagctcaagatgttataaagttgggaaaaaatgtgagattaagatgccgccaactttagccagtggcacagtcaggagtgactttcaggcattgtctccatcagttttcaggaaggttgtttaaatgcggggagtaccatggggatgaattacccaccatacagatactgaggtgtttaaaaatttcgtatgtccaagcatatttaactttaaaatttatttttgttactaataagtttcttatttcttcattcttaccttctttgttgattcttaccttcttttattttatttttttttgtttttattttttattttttaaatttattttattttttttctttcttttttttaaattatactttaagttctagggtacatgtgcacaacgcgcaggtttgttgcatatgtatacatgtgccatgttggtgtgctgcacccattaactcgtcatttacattaggcgtatctcctaatgctatccctcccccctccctccaccccacgacaggccccagtgtgtgatgttccccaccctgtgtccaagtgttctcattgttcagttcccacctatgagtgagaacatgcgtccaagtgttctcattgttcaattcccacctatgactgagaacatgctgcgtttggttttctatcctttttaatgaacaactatattgagagagagacgggtaggcctggacttcctgtccagttagtggacacttgcctgtctgttagagcccaattaaaagctcaggcccttcaagaagtccttcttccatcctctccaaacttttagttctacggttaatgaagtttagtgcttcatcattactaatgctctctaggtgtcagtccttgtgcagttctcccttttttttttttttttttgagataggatatcactctgttgctcaggctggagtgcagtgataccacaatcatggcttactgcaagttcgacctcctgggctcaagcaatcctcctgcctcagcctcaagtagctggtactacaggcatatgcaaccatgcttgactaatttttttattttttgtagagacagggtcttactgtgttgcctaggccggtgttgaactcctggcctcgagtaatcctcccaaccctggcctcccaaagtaatgggattacagatgtgagccactgcacccagcatagttctctttttggcttcaggttcaactgatacttactgagcagctgcatactgagctaggcattttcacatctgtttctcatggagttacatccatgtcacaacctaaacatgatactgaagtaggaatcatcatcactttggtttacagataaagaatgtgagtctcagataggaggcttgtttcagggtcatatgcttaataagtggcagagccaagagagaaacctgggacatctgacttcaaagccatttttctttcttacataacacagtatggataacacatttcaatagaaggaaagcagtttgatgctggacagtatactgtgtatttattttttttctgacatgcaagtgtcacccacacttttttttttaatattttaattcttccttctgctttttaactagacccagacctgaaagcctgactcatgatttaaagtattcccttatctaatgagatttcaggagtctagggcaagcctccctcaagtgaaacagtggaagtcttactagaaggtagttagtagatgcgggagtgtactccctcaaatgatagaattcacccagagcaaattcaccatgcttcccgatttaatggacatctccctgctgaaagaacccgcacacctggccaggctggtgttcgtgagcctatcactaagattttactgccatctagtggtagctcattgtgccattgtgatcctcacagccgtaactgtagtcatgcagtcatcaatgacccaagctttggttaattactactgagcttttagaaatgcgataacatttgtatagcgctttgtaaagggcaaagcgctatataaatgttaactgttattagaactaattattagatggcctagtacttaatctgcaggattgcctacagtaaactagggaattgaagattcatctctgattaattttaaaaaatatatatctgagttgatgcagcaacacaaatatcagaattgcttagcttttaagtttcaggatttcttttgctggtgatattttaatatactctgataatagattcaaataagtaatgacataatagtgtatggaatttaaaaactcaaattatctttatcatttgttagcactcttatagaacatttatgttagcaactccaaagttcagtttcatacccaatattataatttgtttttatttcctctgttggagacaccaacacttaactcctttttgctttcagtggacagaaagttataaaagctacctctgcccaagctattcttggttcaaagctggcagacatatcaaagagaagctagaatgaggtaaatatgtggaattgctgaactaagcacctgggggaacattttaagacttagaacaagaataaacacattaaaatatagaagatttagaaatcagagggaaatcaggaataaagttttaggactacattattggtgcatactggaaaattgagatgaatgagaggggacctattcagaggggcaatagatgtatatgccatagcatgtatatacatacactgttatatattcatatgttacaccagtcacttaactgccgctgtagcaatgaatagaatcgctagtgaattataacgttgctcaggttatagtaataattgctatgataaattttaggtaaatgtgaactagaaacagatgtgtttttcaaagccttaatacatctatctcctgagatgatgaaagaggggcttcaatctaggggatagagatatttatgtgcccaggatagcctgaaaagcaagacttacatacttccttgtttattcagaaagttaaaccctattggaatgagctttgagaggaatttgttttccagatgagcccaatattcctctttctgaaattagtctggcaagaaacagaaactgaattttcttggttgaatcttgcatgatacgttcagtgaattttactacttataaaatttgcctactactaaacataagaatcaagccttgcttttttcttcttcctctgtagatcttctctctactctagactcttaaaattcttcatttggttagttcttcagctttcaataaatactggttgagtgcctgtatacgccaagcagtatactaggtgcagcagatactgtggtagggaaaaaaacagaaaaggtatacccacccttatggagctttcaggccagggaagagataataatcaaccaataccccaaataattttcatcagagtttataattaaaattgtatgaagtaaattagcacagggtgctgtgggagagtattaaagaggctctctgctgggcgagagatgatgtctctgaggaagtaacatttgaaatcttaagcataagtagcagttaaatagtcaaagagagaacaacagtcaaatgtgtctaagtattaatcaaattttgtctaattatatctttggtctaattctgtcaaattgttatatgcatcaatatacaaagatagccaaaaaacttccctgtagattctaaataatagcaaaggctttacattcatattaatcaagagtagcctttcctcttccgtaaatgtgattagtctcaaaagcatgttctattgagatcttagatgttgatttaactggttgaaaatgcattgagcttgttaagtttacgaagctgtaacagcagttctgcctgactaatgatggattattactgtagtagcttctttacgaaggatttttgaatggctgatcgttatgcaacagaaactagaaaaacacacttgagatacggtgccttctcatacgtattccatcatggcaccatgaagggcactgagaggggctttgggtttggcagatggggcagaaggctaggaataaaaaaaatccccttgtattggccgtgctctgctggatgctctctgtgtgaccttgagcaaatcctgtagcctgtctatccttctgggtatcttcttttaggtgtgggtgctccatttgcacgttgggggaagtaagtaacatgttcataaaattatgcaaatgttcttgacactgaccaagggggtagatgctgtttaagagcaaaatgacctaacatgtgggcattgagatacattattggagaaatgccctggaatgtcttcttcggcagcagatatcatgatgagaggcaaggcaagccagagtaagggtgatttctgaaaaaacattgcattttctccatttaaaaaacaatgacaaaagctttttttctttaaagtaaagcattaccacaagctgcattatcttaccatactatcttgaagttttctgagagaacaattattttctttaaatggatatgtattcattcaggagaattgggggcacaaagccctagatttcaattgaattgtcacatggggtaacttttgacaagcctgtcatttgtccattttctcttctgacccagtggtattctgcaagatcagaggggagagaaggattaatgtcattgtgcacaaacagtttctttaggaaagaaattccacttgttgaagttgactaggaaacatgaaacacttagtagtacctcataatcatgccttgcatttatcttctttgctattagtcagatatcctcagctcacatcctgaattttagtcttttctctccttatgcagctgatcacagtatactcaacatgcaggtaggggtgttgcagggaaaactacagcatttctgtaagggcacaaataaagctggtttatgccttttcctcttctcacccataaagtttaagtcaaactatttcctgccttttgtttttatctagggggtgtacagcactagcatgggccacagatacatgttttgatgtcaggttttcattttgaggggagaggtatgtgtacttgtcatggatgatggggcacaccatctactaggcagcagaatttgaatccagccatctcaccaaggtttgagagctctgtaaacacccgtggtaagtgaagagcaattgtgtggatttcttatgatcctaacatcttatcttttttggcttccaagcacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtaagagatggaggctacatttttttcccctctgctctcttttgttttcttcttgccacttattttggacttaccatattttggtaaccctataaattaaattcttcctcaaagagaaaatctgaatgacaaacaaccaatattagatcataaggttttcatattatgtggcagtttaaatcaacttaaacctaaatgtggcatataagataagagcctttagtgaatacaaaacctaactcagcatcactagaaggcactttctaagaagagctgcaatttctggaagaaggttaaatcgagatttttagaattgtgctcaagccaaatataactttcaaaaatgcccaggaataagcttcagaaactgctgatcaaaaggcgtttgattttttaaaatgtcagctagcataaaatattattgagaaaattcgctttaccacacttagagaaaagtttttttctgttgtggtgcaaaaatatgcagaattggagttcatgtgatccagttcatgggtgttaaccatgtttttagatggaacatttcaggcatgtgtcatgcctgtctctattttgcccaggtgaagctggaccgcttgtactcttctttgagaggagcagggtatgacctcgtggcctggcctgattctctctctcattagaacagattctattttatcccagcctgcccatgagctattgatgagtacataatggctgctgtgtttccctgctcagctcctctgctttcagcaataggacttgttgaattggtgaatttctttgggcacagaggaatgaagttttgttctaagacatgcactacatttccatttttaaagcagtgtagagtgtgattttaaagtacgtattttttttaagccaaaagagtaaatcttgcaacctaggagcaaattaattataaatgaaagcaatgtttttataactgatgcatctgtaatgttttgatttataaggccttaagcaagcagtttttttttctcccctctgatgttttattattcaacttctgccttagaaaccacttatatttttcatgccatatcaaccagtgctagaagttgaattttctactttgtcttaacagcattcttataagggaggttttttatcacgaaaaaaggaggtagcagagaggggatgactaaatttgatgtgcaaaaattgagactcagatagattgggtgacttgcccaaagttactacgctagtaaatggtcaatttgggacatattcccaaatcttggctccattcccaccattgttttttacccatattttatttattcattcattcattcattcattcattcattcattcattcatcaacatattaagttcccacactagtgctatgaggcaggtattagtattcctattttatacaatttatctgactccagaatccatattcctgttccagttatgctccactacttctcctagggaatcttaatggagcagtgtttcacttctttgaatttcctatcctgtttggccttggatgggaatgcatggcaattaattagtagcacccactggtgatgaaaatctgtttccttctgctgttgataggtgctgtgctctggcataatgtggtgaagaaatttactattatgagtctaaagacctgggcttgaatccctcctttgtcacttgctagctacatgaaattgagcttcaaagttcttatctataaagtaggaataatcatacccatcatgacagtgttatgaaatattacaatataagttaggcagaaaaacagtgcccaatccatggtaaatgtatgtgaatccaattcttactctgggggggagtttgacagaatatcttgtcaactaaaccgagttcttttatttttcctcctgaagacatatttttctgctgtattttcttctcaggtccttgcctacacacttagctgtgtatgtacatcagcgttcagtgctggaattattgaggctacagaggctgaggatgttatgaacaagcttcgactgttagtggagaatagccagcaggttggaacgtgtgccctgattatttctctctgtgggtctcatgctgctgctaagttttgcttttgacttactctgaattagagtataatgggatatttttcatgtctagaactgaggaacttctaactattctcttttctcacagctgtagccaaaagtcacagatgtctttttctctccttatcccctgtctcattctgtggacatttctttttctttgagagagtattgatatgcttttctctctctctctctgacattgctctatagttataagatcataaaatatatggctagggaatataagagttatgtaaagttagaaacaaaaatttgtgacgatatgaatacatagaagtctctgataaagtcaaacttcagaaaattcaaggcagaaaatctctactcatgaccaaatatgtataagaaaatttaagtacctataaactaaattaagtaaccttaaaatgtttcctgtgaaatattattcaaccttaaaaaagaaggaagttctgatatgtactagaacacggatgaaccttgaaggcattatgctaaatgaaataaacaaataacaaaaagcaaacactgtgtgcttttacttacatgagctgcgtagagtagtcaaaagcatagagacagaaagtagaatggtggttgctcgggcctacaggaagggaggaatggggagttactgtttagtgggtaaagagtttcagtttttcaagggaaagattctggagatggatggtggtattgattgcatagcagtatgagtgtacttaatgccgctgaactggtattcacagtaaagatgataaattttaagtgtacattaatacaatttaaaaaaactgaaaaaaaacattttatctgattacacatgctatagaatttccccatgtggattttttaaaggtttctccactgtcttaatattgatgataatgggttattgcagaattcattggttttaagctcgtaatgttatcgttactgttttatggttatatacccgctcacttacattcagagtaagttgtgaaaaattgaaatgtagaatttttcatatactttgctttttatgggatgctttctttttgtttaggagttgattgaccttgtgtggtctaccttggttttttcaccctaacctcttcaaattgtttgagctaagctgctcaatagtgcagtattactttcctgaaataaattactcactgaagctgaattccttgcaattagaccctgcagtttatgatgcaaaccagtctagattaaaaaaaaacaaaaaacaaaaaaacacttaagtctgatttttcatatgacaaatacagcttgtcattaggaaagttagcactaaaagtgtttatgttgctatttataaacattctaaatctgtgtcttttttttttctttttcttaccccatttttatttatttatatcagacttcaggttttgccctggctttaggaaacatagttcatggattgtctgtgtgtggacatggaaaagctgaagacttgggcagcaaactactccctgcctggatcagaattgttctaacagaggtagaggtcacctgttgtatgctatttcatatttttataatggaaaaagaactactttattggatcatttataggagttgctgagatatatacgttaatggtaaaagaataggcaattttaaatgaaagagatcacatacttttaaatcccttataaataatgcattctgccaactattataatttttttgaactggctattttgtctgagttttaattttaagacaacattttgttttttgaaaaataaaagcaagaatccacccatgatctaacaaccttaatctgttactttattttagtctgctgccatttttggttcagttatacaggttacgttgaccctataagtttggtaccaattcgaccatttatttctccgtgtcctcagaagttttatagaatctaaacccaaggactgattccctcttttcatattctgatgctttgttttcagggcactcccacaatgctttgtctggcagctcttcatggcatggtggccttggtaggctctgaaggggatgtaatgcaggtaaagaaaggaaccatggaggggaagacatctaaatatgtacatagccatagcgggagaagaatacccagtgttttagtatgctaagaacagaaggatttatgctcatggtaatagttacaccagactttttaatgccttgctgtatgaataattgcacttaaccaaggattatttctatagaggtttgttctttatttaatttggtttttagagattaaacctggccaacttaggtgctctccacaaatttccctgcctgagaaaagatgattgaaggataagaaatttcaaaagttatttgcaagaaactccattttgcatcttaatgtctgatatatgtctatgtggttgttctttaacttcaaaatattttcacagtggacatatatatgtgtaagtttataagtaattctaaaggagctctgtttttatgcattaaaagttgattgagtgattgcttacatgccacagtgaacaggtaccaggaaatcaatgatagataaagcatggggccctgcctttgaggagttcatagcttatgtatttgaaatagaaggacataatgataaactgttttataacttagaagatggatagctcatgcaccgggaatataactcttaacttttttatgggggtgggtgggatgggtatttcttcttattctttcagctgaaatcagaagccatccagacctctcattttcaaggcagacttaatgaagtcattagaaccttaactcaggtgagaaaatgaatttaaaatccttgggtggaaaacatatccccctttgttgtctttttttctattacatgatacaacatgttttacctggaaaatgggaaagtctctggttattcccgctgagttcaagaggcatttgggagtgatgtgtggacctgtgttaactgacaaacatgcactacctttgggaaaaaaagaaagctggcattttttttagtaaacttaagttggcattggtttttcttaaaaattaaagcctgattctgcgaggaatgtcaggccctaaagataaggaaaaatagaaggtgatcaaagggcatggcagatcttggtagaaaggtcaagaggcactaattcagatgtccctgataaaagtgtttgggcatatcattttaattgttatccttgactaaagaatagacatattaatctcctaagaaatgtttttttgttttaagatttaaaaaaaaaagattatgtttgttgcataaaatttgaaagcacgtaatgaaagaagctgaaaaaaatatcactgatggtccttcaaacctgaagcaactgttattgatatttcatcatacttcttttcaagtattcttttgtttgcatagttggtattcttagtgtatatagaactttatattttattcttttcatttagcatacttgttttcgttcttgtaaaatgtggctgatgataatacctatcacataaaggagttttagtaattcagacttttaaaagcaaacaaaaatctctgaacagacaaaactcttttttgcatgtatgaatagaaatattctcaaaaaataattctactgaaatttaagttaccataatgtgggagaaaaaatctgtaaatgaaaattattattttaaaaatccttatgaatgataaagcagcagtagagcataatttacagaagagaacaaaatgtatctccttccatttttagaggtattttcatcttaagtaactgtcaccccttttgtactttctggattttgttcttttgcaatttttttgaaaatttatttgagaccagtctcactcagtgaaacctgagaaaaccactagtactttctgccatgattaaatgattgattgaatcattcattcattcagcagacagttgttgagtatctatatgacacaggtatagcgtactagacacatgatattacatcttgtcataggactgctcgttgccagccaagccaccacctcctaaatgactggtgactttctgtgagtgaccttttattgaatggaacttggatcttatcccatcattgaactgttacctttttatttgtaggtcattagtgtctctggggtgattggtctccagtcaaatgcagtctggcttcttggacatcttcatctatctactctatcctcaagtcaaagtagagcctctggtaagattaaagtcataaaatactggagctggaagggagggattgccgacccagcgctctgtagtttgttaagagcattaatcttcacaacaaccctaagtaatgggtattaccatctctgttttacgtcagagggaaatggtgtatggaaaggcttcctgacttacccagggtcatgtgacagtaagtgatggacatgtggtttgaactcagatcttttggcctccaaagctcatactctttttactccttctctctgcctcccttagagaacagtttagacattcagtgtcctgtatttcacaaacgaagaactcatggctcggaaagattacatgagttacatacagagttaatttggtgacaaatctagaaactaggaaccaggtccttaaagcttggaacagatttattttactagatgtaatggtagtttgtatagtattcatgtttcattaaaagtctcttcatatatggctggagtttttctggcctccgattttgaaaaaataatggggtagtacatttaaaggtgtgtaccttcttagccttggaattgaaattctaggccttaatatgacaaggccttttctatttctagctttttggtaaaagcagtaaaagatatttgcagtcccgacatgcttaatgtgcatttgtacttggagattttctggggaaggcatgaccgttaatacatctgctccttgctctttatagaattttgacccactggctatcttggacccaggccagagaggttcaggtaccaatgattccttattaaaacttagttttacttacccactgacaagtagtctacagatggcattaacgtaaatgtgggcctctgaaattaccattttcctttctttcagtcattctgtagctatggaaataggacaactggtccacagccttggcaatgtagtgaactttagacagctaaagttaccatattaaaatggaaaaaagaagaaaacttagtcataccggaagccctgggtaatactagttttgaagggcagggatctcacagtgtcctggtaagataggatatttatggcaggcttttatttttttatgtaggcttttaattgccatattatggggtacttggtctggcctacatatactcaaatcaggtactagtgaatcatcttatacccaggttcttctgaacaaaatgattgtgtatctggaaaagtacagctacttgttcctgatggaattttccaattgagtcatttattgcagtaaaaaccatctcatgaaacaattatgggaaactggaaggaaaagaatttaggagaaactcaggattcaactagcataaatgtcactgcttcaccattccagctcagcaaccacatctggttatttgcacatgttggtcacttacaggtctctgccttaggtaagggattggtgctgttagtactagttgttgaatttctatggttcatatattcgattccacatgtcctgaagtggcacctactacagtggtctcagcgttgaagctcggcagactcgttgctgaacgctgaggaggtcactggattagggcttattgatgtgacaatgtggaaagggtttttttttttaaaccacttcactcaagtgttcatcctccgtaattttttttccagacttttctaactttgccaccattttagatttgcttacatagcttaagtgattacttcaaggccagtcacttaatctaatagaattagttgcagccacaaagtgttgtgctgagattaatggcataaacatctccactttgtctctaggttgatatggcagcatgagatcattatctttccttcattagtcctgccaagttcactggttaatttgatcattttctgtctccacagttcctactgactatagctacttgcctgaaagcagttttattggagcagctattggcttcttcattacaggaggaaaaaaaggcaagtgagcacatttcttgaattttatcattctatctccatgttgttataagtaaatttgtgtaccctaagcatgcctctgtagaatcaagcaatataaatctgaaggggtgaatattttcgtctgctaaaccatctttgcaatagagatgaccagcagctagctacaataattggtacgtaaatatacacattgtgtggtttcttagaatcactgtctccgaccatgggtggctctgtgaaaatcttaatctcccatttggccctttccaaagtataagcacagattacttttcctatccatttcaagtgagtgtgatctagaaagagaaaatacacctgggtgcagtttctatcccgggatctgtcttgcaagtagatcttctccctgcatcttttataatcattctgtgttgttgaaatcactggctctagttcctatttttagtttgtgttcttttccttgcacacatttgagcctttgtgattctgtattgctgccacccccattaaagtacaagcaacttgaagacagagattgagtgccttttgtttttaactggagccagaacagtgccatgtaacttattgaataaatgctccttaataatacacatatagttttcagggctgtgaggaaaaaatggattagaactgaacatgtcatggctcaggaatcagcttcgttaccgtgatattctttcattgatgggtttgctaattttattcttccttggctaggtcagtcttccttggttaggtcagtctgggcaaaatcagtgcctgtattatagcaagaccatcccaattttagaaaggaaaaaaataaacaaaaaaactggaaaaaatctggaagtggcagtttgatttgtgagggtcatggaagtaaaatgttacctttggaagggaagttaaatctgtgttgtctgatttcccactgggtacagtaatccctggagcttccagattttgaatattttcatagcctggagacaaattccattaatttctggagttctagaatttgtgctattattctagggtcctgaattagcatgatttacttatcctcagtaaaaattgacatatggttatgtcattgttgtacatgacatatttatatataaacagatcatatattacacgtaatgtacagttagttcattgtttatgttaccataaattaagtctacttaaaataaatattatagtagagatggcttcattaggagaaaattcttactaaatgagaatctaaaattttcatggccaaactagtgctaggaatacatatatatttctgctatattttttgttaggttgcttattgatatgaaattttaaaatgatgtgagatattttcatgagaaataaaagtaaaaactcttaaggtcaagtagaagatagactctttttcttttctagtgaataaaatgttagtctagctccccagatccatatttcttggcagacatgaattttctctgaatcttattcaatcttcggttgaatgtaacatttttatgattctgtagtcatcatacaacaggaaatgttctgctataaggctgaaaaatcaagtggaactggaatcagtgttgttatgtgcagtcttgctgaaagctgttttaaaacaaataaatgaagtattaagaatgccatattaccaatcagatttttggcattttcaggttgtgggagagggctgtcgtcttgtcaggtttgctgactagattcagaggaaaatctattcagccttacacattactaatgatgaccccagaggagtgggggccgtgggaggctgacctccgcctccaaagcccatttacaaaaacaaaaccagaccctgctctgtggggctaaatgggatggccaaatgcggaggtgtgcatgcaaacgagtgttttcttcttcaatatacccagctcatttgaattttaataactcccttctgaagcagcttttgagtttaaatgtctggatgtcactcatcagagcccggtgggactgctgataggaaggatggcaactttagtgaactcttttgaggaataaatggttttagaaaataaaaataatgcttagcataggcagaaaagtttagggatggcatggtttcattgtctctgcttgctacttttaacttcagcaactcactagaggaaagaaatgtgatgggccatccccaatccacatttgtgctaggatgagtttgggcatggtggtctcaaatttagccaatcaaatttgagatagtgaatctgttaatctgttttctaatgtttagggctttctcacttaggatactgactttagtactcatgtgatagaacatataagatgttcatagcatccattctttcatgcagacccacattttaaaaagatactaaatagatgagattccctcagtttttaaataattcaattcatggttttgactataactgggtctttttttttttttttgctataccatgtgacattcttctttcttctctcatagccctggaattcctctatcagatatattgttccttaatcttttgtcgtcattattatctgttcttgtgaacatttcttgactacgctagccttaaaatctttgctcatcatctaattcctcctaacatggatattttttccccctgaagaacctctgacttttgacttttacttttttgcttcttttctacttttattcttttgtctgatttctgattttctcaagatcataggctgttcatatctcatcaagattttatccacttcttttataatacattagaaacatatttaaagtacttaataaaagtgattctttctaatgctaatattagatatttctatgtaatagcattatttttgttattatattgctggggaatgtggctaacactttctaagcttatattttcctattaggctttaaaaattcacagtaagaagtattaactaagcaaagtatatttaagtccacgtaatagtcattatgaatggctttctttcttgatatgggctaattggtcagtgatctgcgtgtgtaagtattgggcttggatacgaagtacaggtaggcatatgctccttcagtcatttttgaactattaccatgagaggtaattgttaagaaggaaatatgccaagggaacagacttagtgaactctgagtagaataaataatacgagaaagctgtcctgttttctgatgaaatcatggagttggttgccaaggttatgtgtgatttttgagtattttaatttagaaatagtttacctgtacaactctttaaaaaatattatcagaagtcagtatatctgtataatactaagttaaaagtgtatatagaagaaaataagacaatcctctgtcatgtcaccacttggagatagccattataaatatgtccttcataatgtcctcctatatgtatgtgtatgtgttatattgtaccataaaatgtatattattttattgtcctattttaaaaaaagtaatgactttacatgcaaatggacataactagcacccatgtcttccaaaaaaagccttgaggaagtaagaaaagaatcctattgcattggtttctggacatttgtcaatagcatatgtttttggtgtgtttgattccttttttgtttcatgaggtttgttttcataaacctcatgaaaatgtttggaaggaaaaatgtcaccaattatcccatgactctacagctattatcatttctggatattacttaatttgctgcttctgggattacagccatgcaccaccacgcctggctaattttttgtatttttagtagagacgggacttctccgtggtggtcaggctggtcttgaactcccgacctcaggtgatccgcctgcctcggcctcccaaaatgctggaattacaggtgtgagccaccgtgcctggcctgtatttttgaacttaatattatattataaactttccctgttttcatatatcaccataacaattgtataataacagctattatttttgagacaaggtctcggctctatcacccagggtgaagtgcggtggcacgatcatggcttactgcaacttcaaactttctggctcaagtgatccttctgcctcagccccccaggtagctaggagtgcaggtacatacaaccaggatcagataatttctgtactttttgtagagatggaaacaatgttgcctagtctggcctcaaactctagctttgagcaatcctcctgacttagcctctttaattgttgggattacaggcatgagccactgtacatggcataatgatcatttttaaatgactatagaatatttcatcaaattcataagtcataataaacttaatcattttcgtattggtcatttttaaaatttcaattttagtgaacatcttttcttttcttttttttttttttttgagacagtcttgctctgacgcccaggctagagtgcagtggcgtgatctcggctcactgcaacctctgcctcccaggctcaagtgattggcctgcctcagcctcctgagtagctggaattacaggcaagtgccaccaagcccaaagatagatagatagatagcatagatatctctctctcttttttttttttttttttttttttttttttagtggggtttttctatgttggccaggctggtcttgaactcctggcctcaagttatctgccctcctctgcctcccaaagtggattacaggtatgcaccaccatacctggcctttagtgaacatcgttatgcatatagctctcttctgctacagctttccttcagataaattctcagtaatgtagtgagcaggagtccaaggatttggtgactatagggatggccaggcctcgttgcccttcaaaaagctttgccagttttcagtacctcagccctgtatgaatttgcaaaaatataaaacatagaggttaaaagcataggagtcaggctgcctgggttcatatcccacttccactacttactggctgtataacttcaggcaaactgtgtctgtaagctttgaccacttctgtaaaatggagaaaataattgactgttttttatagagttttgtaagaattatgagtcactttatgtaacagtacttataaaacaatataaagaataaattccttcttttataatgtcatattaaaaagcagcccaaaaaacaaatgataacaataaaaaccagtcaggtataaaatgataccttaagactgctctcatttgcatataattgccagaaggtctgaacatctgtacatttatttactgtttaagaggttggttttttttttaagtaaatttgaaatttttaaaaaaaatttttaattgatgaataattatacatattcatggagtacatagagatgttctgatgatattatgtatagtgatcagatcagagtaattagtgtgtctctcatctcaaacatttatcatttctttgtgttgggaacattcaattcctcctcctagctacttgaaactatgtattattgataactatactcaccctacagtagtatagaacactagaacttataccttccatctaattgtggttttgtatcctttaacaagtctctccttgtctctttcttccccctgctctttcctagcctctaagtattctctcttctactttttacttctgagagatcaactttctttttgcttccacatatgagtgagaacatgtgctatttaactttctgttcctggcttatttcacttaacataacgtcttgcatttctatccatgctgccatgaccagcaggacttcattctttttgagggcttaatagtattccattgtggatatataccaaattttaaaaatccattcatctattgttggacacctagatttattccatgtcatggctattgtgaatagtactaaaataaacatggggtacagatgtctctgatagaatgatttcctttcctttggatacctgcccagtaggaggattattagatcatattgtagttctatttttagttttctgaggaacctccctactgttatttatagtgggtatactagtttacattcccaccaacagtgaatgaattcccttgtcttcacatcctcaacagcatttgctgttttttgtttgtttgtttgtttttaataatagccatcctgactggggagagatgatatctcattgtggttttgatttgcattttcctgatgattagtgatgctgagcagttttttcatatatttattggccatttgtacatcttttgagaaatatctgttaatttccccatcttaaaatcagattgtttattttttgctgttgagatgtttgagttccttgcatattctggatattagtcccttgtcagatgaataatatgcaaatattttctccattccacaggttgtcttttcatgttgttgattatttcctttgctatgcagaagctttttagtttgatgtaatcccatttatttttgcttttattttctatgcttttgaggtcttattcataaaatcttgccctaggcctgtgtcctgaagcatttctcctatgttttattcctgcagttttatcattttgtgtcttacatttatgtctttgatgcattttgaattgatttttgtagggcgagagattggggggtgtagtttaatttttctgtctatggatatccagttttcctagcatcatatattgaacagactgtcctttccccactgagtgttcttgacatttttgtcaaaaatcagtttgctatagatatatagattaatttctgagttctctgttctgaatttatttttaaatttgtatttttttacccttttattttgaaacaatctcaaacataaaaaagttgtaaaatgcatagaaaagtagcaaaaattgtcttccttttttaatagtaagaaaaactccacattcctttcaaccaggggcactattcaagtttcatcaacaatcccagtgatgtttttaatagaaaaacaatctcatctagaatgttgctctgcacttatttattggtctctttggtctccttcaacctgaacactttttcagttttttctgtgacttcttgactttaacgagttttaagattagaagccagttagtttatacaatgctctttaatttgggtttgcctgatatttctcatattagagttaggtgggtcacttttggtagagtatgacagacgtggagctgtgtgcttctcactgcatcccatctgtggcacatgacgtctcagctgcctccactggggtggtgagctttgctcacttggataagatgttgtcttctaggtttctccactatgaacttattcttttacccttatttcaataatctttcatgtggagatgttttgaaatttcacaaatattctattttcatcctattttcaccgattagttttagcattcactaatacttcttgcctgaattattactgtgatggttgtcaaaaggtgatttttaaaaatccatgaatccatctattttttttttattatactttaagttctagggtacatgtacacaatgtgcaggtttgttacatatgtatacatgtgccatattggtgtgctgcacccattaactcgtcatttacattgggtatatctcctaatgctttccctcccccctcccccaaccccacaacaggcctcggtgtgtgatgttccccttcctgtgtccaatgtgtccaagtgttctcattattcaattcccacctatgagtgagaacatgtggtgtttggttttttgttctcgtgatagtttgctgagaatgatggtttccagcttcatccatgtccctacaaaggacatgaactcatccttttttatggctgcatagtattccatggtatttatgtgccacattttcttaatccagtctatcattgatggacatttgggttggttccaagtctttgctattgtgaatagtgccacaataaacatacatgtgcacagaatgggagaaaatttttgcaatctacccatctatgttttttattaggcgttctgctgtaagaaatggctcctctcctctcctctccactcctcccctcccctccgctcccctcctctccgctcccctcctcttctctttctctccctctctctctctgtgttagtgtagactcgtaaattcctatgttatttaactattcagttatctattattttgatctttaacttgtccaataaattgaacaaaatattaaatttgaccaataagaacctctacaagttggctcttgtgtccttttgacatgaccccctcattctttgactgcttcctttgtggcacaagaagatgtcctaggtttattttgtactatccccagccctgtaatagatactccaggtttcttttagtggagcatggtatttagaagctaacatctgtgtgcaaagcatctcattgctgctggggtaatctttgtctctaggccgtttcagtggacagagctgggaaacatatgttcttgttctctctcatgtatttttatttctgtatttagctatatatgtaataaaaagggttcaatctgtctttctttttgtatttgtaactcccttctctgacagtaagaaacttgactctcattatcctcaatatatttactcatttgcccaatcctcctggatgtaagtaatctcctgtccctgctggaccacggtcctaaactgccttcctcactcaggtctccactgggtgccatcctactttgtggccttcctgattttaagaggccttgggatatttttgcttttaataacaaaatgttattgaaatattcggtcttaacatagaaaacctatcaacctttagtgtctgtctgatgtatcagaatcatcaatttattttaaaaactgtcttgattgtagtttctttcagggggctaggcatctcctagttcccactaataggcaatgctgtaattctctctgcctgtgttttctatggacttagtgtagaaaaaaatcgtactcatccttttcatcttgatttaaatattctttccttggtgggggaagataggggcttccgtgatgttcccagattaagttagattacttatgtgatactttcctatatattttcatggtgcgtaatatatgtgtcatcattttcataattatttatacttctttgtttaaactctgtcttttccactaggtgtgatttcctcaatggacaggaagaatagctgtgttttatcgtaaatacttagaacagattggcatgtaatagttttctaatatttgtttatctataactttaaacatacacatatataatatatatatacacacacacatacatacatacatacatacatacatacatacatacactagataattctaagctaagttacctataagcagcatttagctggagaaagtaaagatatgtccaaaccacaaaagcaatatgctagcgatggaaaatatacagactcaggctgttagtctacttgttgccagacttttactctaaggattacacatgtgaattgtggcattgagatctgatcctctgtgtagccaaagtatgtgcgataatgggtcctgttgtaatgcattatgttcggatatactgtttatatcagggttctttgaggctgtcaactggatgagagatttaaagtaactttgtttccaggttttacaacatctggatctttttaacaagtactgttaggccttctcagttccaaatccattgtccgtaaagcatttcattatttctttttatctaaaaaacttgtttgaaagacaaagcattataataaaggaactgatcattcctgttgtttagatgtggattcttttatccagtgctaaagatctctggggaaggaactagttcactgtgttctcccttggctttgggactccctctctttctttccatacctcctccagaatgcatgaaactgccaaatattttctcaatttccaacagctactatagttcctctcattccagttagtgtctgaatcagttccctacaaatagtggaaaattttttgtgagtgtagttatactactcaatactgattctttgcccttttaaatgtggaagatttatttcattattggactgatgtgatttttcaaccctattctccattttacaaattttctttgttgctgacacttgcatgtatattaggtcaattctagcgaatatagaagcaacatgtaaagtgcagtactggtgaaagttgtcctgtcaaaggagagctcattatcttaagaataaaacgtctggaaaatggtcatatttcacatggggtcctggtattagaaggcaggctggacgccttgcctgtttccctagatcctctggaaactccaaagtctttgtagtggattctctcaaagtgcctggaaaaaattttttatgtaattttgaaaatactcaatctctgagagttttctaagtagaaatctatttatgaattaatgatttccagtgcagaattggatgcattgttcttaaatggagagatgtaattcttgcataggtatttactataatgtctgccagtttatcaaactatttctatgaatcatgtgctaagaaaaccccaaaaagcaacttaatttttgtgttttcttttttgtgaaatcaaagactgcaatctgcagccaatgttgtgtagagatacttagcgcatatgtgtaatcagcatggagttatgtgaatagacaaccagttaactcctatcacagcatttttttatcacagaagttattacacctgattttgccttgcttgtttcttctcacgttagaatataagctccacgagcgcagggacctattctgtcttgttcaacactgtctccgctgctagagtcagtacctgatacctaatagatactcggtaaatagttgaatgaatgagtgtgtttataaatgtatttactttatttgtcagaattttttttttccttacaatagcaggggttggccagatgtggtgtctcatgcctgtaatcccagcactttgggaagctgaggcaggtagatcgcctaaggtcaggagttcgagaccagcctggccaacatggtgaaaccccgtctatacagaaaatacaaaaaattagccaggtatggtggtgcacacctgcagtcccagctactcaggaggctgaggcaggagaatcgcttgagcctgggtggcggagtgagccaagttagtgctgctgcacttacttgcagtgaaccaagatagtgctactgcacttcagcctgggtgacagagtaagactctgtctcagaaaagaaaaaataataataatagcaatgattaactctctaaaaatatttcttgaactcccagtattacatctcaagatggaacagaactacaacaccaattactggtagcatagcacagaagagtggcaggtgtgttgagcatcaacatttttttttttgagatggagtcttgctctgttgccaggctggagggcagtggcgtgatcttggctcactgcaacctcttcctcctgggttcaagcgattctcctgcctcagcctcccaagtagctgggacaacaggcgcatgccaccacgcccagctaatttttgtatttttagtagagacaggctttcaccatgttggccaggatggtcttgatctcttgacctcatgatccatcctcctcggcctcccaaagtgctgggattacaggcgtgagccagagcatcaacatttcaacaaagtgaaagagtgtttgttggaggggagagaagcatcactggaaggcgcactactatacctgttggcaggagggagcaggttagtgggtcactagcctaaggaaatgtgctgatttttgagaaggtgctgatgggaaataagtctaaaatatgggagaaaggcctagatcagaagtatggatttatattcatcaacatataagtaatatttgaaactgtgaaagtagatgaactttcacagaggaagaacaccgaagcttaaggaagcagttatttcaggaatgagggcatggtactcttttatatggaaaagtatggaaagaaagactgagaaaatacccttgaatttggcttttagatggccattagaaatcttagccagggtagttttggtggagtggcagggccaatgtctatgtagcagttgtgttagggtactttttattccagaaagcaatgattctgacttcaactgactcacaaatacttgttgcaaggattctttggtttcacagaaatccaaagacagaaactttgtttttgggagtatcgagaacagaaagatatcaggcgccaagactgtatctctctttttctctttttcaggggctgcatggtatcagtttctcttgtggtttctacttttcttctaaagactcatccatccctttctaagcttcttatgctttttttggtgataaaatgtatacaacatgccattttaaccatttgaaagttttctgtggcatttagtgcatttacaatattgtggtgccatcacgactatttccagaatgttttcattaccccaagaggaaacattaagcccattgaacagttgttccccatttcccatttttccaagatcctagcaaccaataatttgctttctgtctttatgtattttcctttcctttaaatgtcatttaaatggaaccatacaatatgtggcctttgtgattggcttctttcacttggtgtaatgttttcaaggttcattcgcattgtagcaagtatcagtacttcattcatttttattgctgaataaaaatccattgcatgggtatgccacattttatttatgcatcagtttatggccgtttgggttgtttctaccttttggctattgcaagtgatgctgttatgaatatttgtgtacaagttttgggttgaacaccttttttcaattctcttggtgtatatatatatctagaagtggaattgctgggttgtatggtaattctgcttaactttttgaggaactaccaaactgtttttccacagtggccgcactgttttacattcttgcaagcaatataggagggttccaatttctccacgttctcgccaacacttattttccattattattatcattgccaactaattggctgtgaaggtggtacctcacgtgatttgggtttgcatttccctaatgactaataatgttaagtatcttttcatgtacttattagccatttgtatatcttcttggagaattatctgttcaagtcctttgcctatttaaaaaaaaaataaattgcctgttgttgagtcgtaagagttctttgtatattctggaaaatagacccttatttataatttgcaaattctgccattctatagattgtctttcatttacttgataataccctttaatgaacaagtttttaacttcgacagagtccaatttatctgcttttcttttgttgctcaggtttttaatgccatatctgtgaatccattgccaaatccaaggtcaaagatttacccctgtgttttcttctaggagtttgattggtttagtccttatatttaagctgttaacccattttgcgttaatttttgtatttagtgttaggtagggacctagcttcattcttttgcatgtgagtatctagttgtctcagcaccatttattgaagaaatcattctttcccccattgaaggatcttggcacccttgtcaaaaatcaattgggtataaatatatacgtaatttctactctcaagagtccagaaataaacctatgcactggtctatatgtctgtctttatatgtactaataccacgctgttttgattactatagctgtatagtaagattagtgtgcatgagttctgtacatttttcttttttcaagatatttttttttaggtatttggggccccttgcaattccacatgaatttgaggattgactttttcatttcagtggagaggactcttggaattttgatagggattgcattgaatctatggatcactttgggtagtattataatcttagaatattcagtattcgaatctgtgaacacaagatgtctttctatttatttagggctgctttaatctctttagcatattctaaacttttcggtgtataagtctttacccttggtgaaatctattcccagatatttcattcttttgagtgctattgcaagtggaattttttctaaatttctttttcagattattcactgccagaatataaaaacacaactaatttttgtgtgttggtcttatatcctgcaactttattgaattcctttattaactctattagtttttaaaaagattgtttgggattttctctatataggatcatatcatttgcaaatatagttttatgtcttcctttccaatctgaatgccttttctttttcttgtctaattgctccggttagaacatccagtacaaagtggtgaaactgggaatcctgtcttgttcttgattgtagagaaaaagctttcagtttttcaccattgagtatgatttaactgtgagtttttcacagtttttctttatcatgttaacatagtattatgtgtgttttttatcggaaaagggtgtttgtcaatgatttttctgtgtcaattgaaatagtcctgcgggcttttttcctttgtattattaatgttatatattaccctgattgattttcttatgttgaacaaactttgcattcctgggataaatcgtgtttgatcacagtatataatctttttaatatgctgttggattctgtttgctagtgttgagaatttttgcatctatattcataatatgtatcagtctctggttttccttttttatgatgtctatgatatcaggataatgctgatctcttagaataagttaggaaatactcccttctcctattttttgaaagaaattgagaaagattggtgttaattctttaagtgtccgggagaattcaccaatgaagccttctggtcttgaacttttctttgttgggaaatatttgattgctgatacaatctctttacttgttataggtctgttaaactttctatgcattcctgactcagttttgataatttgtgtgcttctaggaatttttcgatttaatctagattatctaatctgttggcatacattttttcgtagaattctcttgtaatcctttttatttctgcaaggtccatacaaatgtttccatattcatttctgattttatttgcatgctctttatgttttttttcttagtctagataacagtttgccaattttgtttatcttttctaagttccaatttttggttctgttgtttgtattttcttattcttttttttttttttttttttttttgggagagttagagtattgctgtgtcgcccaggctggagtacaatggcgtgatctcagctcactgcaacctccacctcctgggttcaagtgattctcctgcctcagcctcctgagtagctgggattacaggcgtctgccaccatgcccagctaatttttgtatttttagtagagatggggtttgaccatgctgtctaggctgtcgaactcctgaagtcaggtgatctgcccacctcggcctcccaaagtattgggattacaggcatgagccacctcgcccggcctgttttcttattttatacttaattatctccactctaaactttattatttccttcctctacctttgggtatatttgctcttcttttttaagttctttgaggcataaagttagggatattgattagaattatttctactttttaaaatgcctttttaaaactggcatttattgctgtagatgtcccccagtatactgtatttgtgcaattccataaattttggtatttttatttttattttcatttgtctcaaagtattttataatttccctgtgatttcttctttaatccattggtcatttaagaatatcttttttactttccatttattagtgagttttccagtttttttggaaatctgttcttgatttctattccattgtgtttatgaaaatacttggtatggttttagtcttttaaaatttattgagacttgttttgtggtctgacatgtggtaagtcttagagaatgttccgtgtgctcttgaaatgaatgtgtattctgatggtgttgagtggaactgttctagctatgccagctaggtctctctggtttacactgttgattaataaggatcctttatatcctcattaatcatacgtctagatattctatctagtattgaaggtagagtattgaagcctccaaccgttactgtagagctatctatttctcctttcaattctgtcagtatttatatatttgggggctctactgtttgatttgtatgtgtttctaattgttaaatttcttgattaatctaatttgaattgattccaactgagcatcaacaacatataaaaattctgctcttataaagttctatttctccctttcatgttattactgtcccaaattacatttgtatacattatgtgcccattaaggtagatttataatcattgttttatgcatttgccttttaagttacatagtaagtgaaaaggggagttataaaacaaaaatataaaaaaatatatatatatagatatataacaaaaatataatggcttttatatttacctatgtaattacctttaccagaattctttatttctttgtatagcttcaaattattatctagattactatttagtgtccttttattttagccttgaggactcccattaacatttctcgtagggcatgtctatgggtaacaaactccctcaactttgtttttctgtatatgtcttaatttctccctaatacttgaattatagttttgttggatacagcatttttcgatgacagttttttttttttctttcagtaaaaggtgttatcctgttccttactggactccatggtttctgatgagaaatgagctgttaatcttattgggaatcccttgtatgtgatgaatcacttctctttgctgctttcaagattttcagtctttgtcttttaaaaatttggctacagtacgtcttagtgtggatctctttgcctttatctttcttagactttgttgagcttcttgaatgtatggatttgtgtcttttttattaaattggagaagttttaggccattactttttcaaatattcattctgcccctttctctcctatccttctgagattcctgttatgcctacgttggtatgcttgatgtatccttaggctcatacttttcgtctttcttttttctctgtagactgagtgattttagttgacgtatctttatgtgagttgattcttttgcctgctcaagtctgctatttaatccctctagtgagtttttcattgcagttactgtactttttagagtacagaactctataatttgtttggttcttttaaaaaagaactctttttgatattctcttttttcttttcttgtattgttctcctggtttcttttagttctttgtccataattttctttagctgaatatatttaagagagttgctttcaagtctttgtctagtaagtccaatgtctttacctcctctgggacattttctgttaatttcttctgtgaaatgacaaagcttccttgtttcattttatgctccatatttttttgaaaactagacttttttgaatgttaaaattcagttttattccaagaataaaacaaaatattgtaaaatatgtaacataaaatttaacttttaaatatatgattttatgacattaagcattaatgtcacattaaacattaattaagcaataatcaccaccatccagcttcagaactttgaaaactgaacattttggatattgtaacagggtaacttggagtattacagtctttcttttcctcattgtttgttttcatttcttgctgtgggctatgttcagtgacttctcaaaattgtaaagtttgtctgtcttctttctctctgaaggctctgttcttttagccagtgattagctagtgctgacagagatttccttgaacaccagaagtcaaaaaaaggaaaacaaaaaggactctgccttttctccataatgtgattattacacattgcatgcctatatcaaaatatctcatgtgccccatgccccataaatatacacacctactctgtaaccacaaaatcaaaaattaaaataactctgctgccacttccacttctactttttctttatctctaccaattatgctgctatttctgaatatgcatcttcttttttaaaacattgtagtgataagtacacaatgtaaaatttaccctcataaccatttttttttattttttttggtgggggaggacagagttttgctcctgttgcttaggctggagtacaatggtgcaatcttggctcaccataaccttcacctcccgggttcaagcaattctcctgccccagcctcctgagtaacggagattacaggcatgcaccaccatgcccagctaattttttgtatttttagtagagatgagatggaatttctccattcaatagtgttaatgtgaatgtatattcatattgttatgaaacagttctccagaacttttcagaacttagaaaactgaaactctagccattaaacaataactccctttcccccacccctctccctatcccctggtaaccaccattccattttctttttctatgaatttgactactttagatacttcacataaatggaatcatacatttttgtgtgtgtgaatggctaatttaatgtaatggccttaagtttcatccatgctatagcatctagcatgattttctttttttataagactgaataatgttccatgttatgtatatactgcattttgtttattcattctttcatcagtggacatttgggttgcttttaccaattggctgttgtgaataatgctgctatgaacatgggtttgcaagatctcttcatgatcttgctttcaatttctttgggatatacacctaaaagtgaggttgctggattatatggtagttctagttataattttctatttatataaaataatgtgtaaatttttaaggaactgccatactgttttatatagtggtcacatcattttataatcctaccaagtgtacattagggttccattatttgcatatcctgggcaacactttttctggtgtttttgttgctattgtttttatagcaacaaataggttctaataggtataggctgatatctcattgtggttttgatttggtttggtttttttccttctgattagtgatattggtcatcttcatatgcttgttggacatttgtatatcatctttgggaaaatgtctaagttctttgcccatttttatatgctctctttttttctatgttactccttttttagctgctcttttttccttttgttgattctccctctgccctctctttttcagtttctagttgttctgcttttcctgctaattctgcatgtgcttctcttttctcctatgcttctttctgctgtttttcatttttctttctctgcctgctttttcagtatctattcattttgcttctgtttctctttttcaacttctgttaattctgtttctttttctgctgattccacatagcttctcctttttgcagctattttccttctgttgactctgccctatttcttcttccaccttttcagtgtgctgattttacctccgcttctccttgttcccatgcttctcctttctgcagctattttaccttatgctgactttcctttattctggttccctcttctttcagcatctgctgatgtggccactgctccttgttcctgtgcttctgctttctgcagctgatttacttctgctgactttgccctgttctggttccctcttctttcagcatctgctgatgtggcctctgcttctccttgttcctgtgcttcttctttctgcagctattttaccttctgctgactttgccttgttctgattccctctttcagtatcatctgatgtggcctctgcttctccttgttcctgtgcttctcctttctgcagctatttaaccttctgctgactttgccttattctggttccctcttctttcagcatctgctgatgtggcctctgcttctctttgttcctgtgcttctcctttctgcagctgatttacttctgctgactttgccctgttctgcttccgtcttctttcagcatctgctgatgtgggctctgcttctcctttttcccatgtttctcctttctgcagcttttttttttttttctgctgactcttgcttccccacttttagcatctgctaatttggtctctgcttctcctttttcctatgcttctcattcctgctgctgttttcacttttgctgactctgccctacttcccccttcttttagcatctgttcatggcctctgcttctcctttttcctatgtttctcctttctgcagctgtttttttcctgctgactcttgcttccccattttagcatctgctaatttggcctctgcttctcctttttcctatgcttctcatttctgctgctgttttcacgtttgctgactctgccctacttccctcttctttcagcatctgttcatggcctctgcttctcctttttcctatgtttctcctttctgcagctgattttttcctgctgactcttgcttccccattttagcatctgctaatttggcctctgcttctcctttttcctatgcttctcatttctgctgctgttttcatgtttgctgactctgccctacttccccctactttcagcatctgttcatggcctctgcttctcctttttcctatgtttctcctttctgtagctgtttttttcctgctgactcttgcttccccattttagcatctgctaatttggcctctgcttctcctttttcctgtgcttctcttttctgctgctgttttcacttttgctgtctctgccctacttcccccttctttcagcatctgttcatggcctctgcttctcctttttcctatgtttctcctttctgtagctgtttttttcctgctgactcttgcttccccattttagcatctgctaatttggtctctgcttctcctttttcctgtgcttctcttttctgctgctgttttcacttttgctgtctctgccctacttcccccttctttcagcatctgttcatggcctctgcttctcctttgtcctatgtttgtcctttctgtagctgtttttttcctgctgactcttgcttccccattttagcatctgctaatttggcctctgcttctccttttccctgtgcttctcttttctgctgctgttttcacttttgctgtctctgccctacttcccccttctttcagcatctgttcatggcctctgcttctcctttttcctatgtttgtcctttctgtagctgtttttttcctgctgactcttgcttccccattttagcatctgctaatttggcctctgcttctcctttttcctatgcttctcatttctgctgctgttttcacgtttgctgactctaccctacttcccccttctttcagcatctgttcatggcctctgcttctcctttttcctatgtttctcctttctgtagctgtttttttcctgctgactcttgcttccccattttagcatctgctaatttggcctctgcttctcctttttcctgtgcttctcatttctgctgctgttttcacgtttgctgactctggctccacatctgcttctcccatctttcagcatctactgattctgctactttttctgatgattttgcctctgcttctccttcttcctatgcttctcctttctgaagctgtttttccttttgctgactctacttccacgctgattccccctttttcagcatcttctgattcaggtgcttttttgctgatcctgcctctgcttttccttttcctacctctacttttccttttgttgattctgcttctctttctgctgatgctaatttcctttctactgccgatgttgatcctgctccttttgcttctccttggtcttctacattttaatgtgttatactatttctggcctcctcgtagtttcacgtttacatggcccttaatggctattctattcctggttgcaccatatgtttgcactcacaaatgctctactatctgtttttcaatttctaattaccctatacacacttcctttaaataggaatataatattaaagtaatggtactatgtcataggcagctggttaactgatggactagctgttacacagcccttagatgctcacttctagaacggtcaccatggcacaggctgggaagcagaaaaactagagactcccaaggtacagaatgcagtctaggactacagagactaggcaatacatagtccatagaatggagtgtacctgagtgagcagtccttattctctctgctggaagtagattgaggtgtaagtgagcaatgaggtactaatgtaaaagaagttacttaatttggaaaactagataaaaagacaagagtgtgcagaggacagctaagtagcaacgtggaaaatttttatccagtcagaaaggaaagactgtaggcaagtgaaagaatgaaatcatgtcatttatggccacctggagaactcatgttaagtgaaacaaaccagccacaaaaagataaatatcacatatgtggaagctaaaaaagttgatctcatatgcaatgccaaagaaagttgatcttatatagaggtagagagtatagaatagtggttactagaggttaggaagagaaggaggatggggcaataatgagggattggttaaaggaaacaaaatgaggaataagttcaaatacggggaataagttctggtgttctaaagcactgtagggtagtgactatagttaacagtaattgttatttccaaatagctagataaaaagattttgaatgtttcagcataaagaaatgataaatattggagatgatggatatgttatttatcctgatgtgttcattgcacatatgtatggaaatatcactctataccccataaatatatacagttattatatattattgaaaaatttataaaaattttttaaaaagagaagaacagagggagcaagcttttctggcaaatggagttgaaattaagagcacagaattgaagcgttgatcgcaattgaatatgtgatatcagatcctttgatgctagaaggaaagaaggaattgttggcattttccacttccatgatagtatgcaggtgttttactattatttttcactgtctgttataggtcctgaatctgtgcctccttcccttcttaaagtagtgatgaaacccatagcaactgttggagaaagctaccaatatcctcctgtgaactgggctgcacttctctctccacttatgaggctaaattttggtaaatatcatgtgtttttaagtcttcagactttgattttagtatttgacctgaatggaaaaacagattctgtgtcacaatgtgtagtgactggatagacttttcagatcttgaggtttgtcatgttggatggaatggctgggttactttcactcagtcattgagcccctgagggtgaggaagaagaggtctaaagacacaggccagatacacctgccaaaaacaatgcttgactgaggtttgcgcactgctgggaatgtggtacaggttccattaagcttgcctttgtggttatcaaactacatttccagagccataggtttcgagaagtaccatgtgggatgctgtattaattttctattgctgctgtaacaaattaccacagtggcttgaaacaacacaaatttattatctttacatgtccataggccagaagtccaacatgtttctcaccagcctaagatcaaggtatcagcaaattagaatttctttctagaggttctagggaggaattcatttccttttcttttctagcctctagaagctgcccacattctttgacttgtggccccctttctgcatcttcaaggcaagcaatagagggctaagatcttctcacaccatcatctttctggttctctgtagccaggaaaggttttccaactttaaggactcatgtaattaataggctcacttacataatccaggataatctctccatctcaaaatccttaaccttaatcacatctgcaaagcttctttgtcatataaggtagtgtattcacaggttgcagggatcaggatgtgaacattattggggaccattattctgcctaccacagttattttgtggtgagaggcaaacagaatacacacctcaacacctccagttcatccacagcaacctattttatacagaatagagttacacatgcaaatataatttaatgtacttgttccccaccctaactccaaaaataaagtaagaaggggagatgaagagcaatttaaacagtgttgtaaaattgtgtgtgtttgtgtctgtgcctgctgtgagtgctctatcatttatagtagagtgcatacttacatatgatatataaaacaacttctatactgtaatttatgtgtggtttcagagataaagataattttgactacatacaatttttcacttaagtgctttcatataaacctaatctctatataagatataatgtcaccatactgggtttccagagatttcatttgaaaaatgtgttccgctatccctctccttgtttggtgtgctatattgaaatgtttgtgtttcatttaagtccttagagaaaggaaggaaaataaggtgctgattggaatcttattactagaaaggcttgatgactagagaatgtggctctatctttaagccattccacaccttgatatatttcttcatggtctgcatatgagatggagagaagggaaaaacagagatccagagattactagctagaattttctcatattttagatagtgtttgagtgtgtagtttcctctggatatcataagagaaattcccatatctagttcaagcccattgctagttccaaggtgggactgtgatgccattggacatgttattttgcctcataactaacaagtctcttgaaatatctcttctggtttactgaagttctgttacctgcaaaagtcacataagcagatgctttgatttgagatattaaagcctgaaaatgagtcaggaaagtaactatatattcaattcttttcctttcttgactttcaggtgaagagatccagcaactgtgccttgaaattatggtgacccaggcacagtcatcccagaatgcagctgcactattgggcttgtgggtgacaccaccactgatccacagtctgagtgtatgtagtaactaagggtgttggccaacaggaggatattgttctttaggaggatattaacattcatttgggtgtgtgttctcaaagtcaagaggagacagatgagatcttcacaaaaatcgagggtttgatagtagctggcctgcatattggaaaattatatagttcagaaccctgccatagccattaccgttcatgctttagctaccatttattaccaaaagtggaaaatgatgatcagagatattaaagttcctttctcaagatcatatagctagaaagtggtggaattatttgaacttatgtttatttgattatatagtatatgtaattatttcagtacatattaagagaaaggaaatccatatgtaccggacttatccatgtattatccttcccctttcccagaggaggcagcaattaaggtgggccatgatttggttaggtatcacatcaaggggaccaggggatgtaggtgggagagtgtaagtggagagcatgaaagatctctactaggctgtttagcttgagcaaagcgttgagaaagcaatgaccgagtctggtgtttttgatagagggggctagcacctttcacgtataggccaagggcagataggaagaatagggcaagagagtttaaagatgtaaagttagtaaagatgtataattttgattaggtttcaaactagaacagaaaaacatattccatgattctttagaggtttaccagttgatgtaagttaaatgctgtcatcttttaattgtctccataatctggactattcttctgtcctaggaggctttaattgtttgagaatagtgcaaagccctcttatcatttcctcagtctcttggcctttgtccctattcagccttgtttctgtttttttgttgttgtttttgagacagtttctcgctccatagcccaggctggagtgcagtggcagaatctcgactcactgcaacctccgcctcctgggttcaagtgattttcatgcctcagcctctcaagtagctgggactataggtgtgcaccaccgtgcccatctaatttttgtatttttagtagagatggggtttcaccaagttggcaaggctggtttcgaactcctgacctcaagtgatctgcccacctcagtctcccaaagtgctgggattacaggtgtgagccaccacgctgggcctgtttttgtttttttaaacctttcctactcctcctcactgtctttaattgaaagtggatgttatcaaggtctgcatctttctgtcaggtattaacttcattccacctgtctgctccaagtggctcccagctgcctgccacttactgagcccttgctgtgcacctggtacctgcaagcactcagtgagtacttacagaaatcagacttaatttctctacagcctgacgggacagttttaaaagtagctttgttgagttataatctatatagcctaaaatatggctgttttaaagtgtaaaatgtgatgaatttgagtacctttacaggtttttcaatcatcaccaagaatatttccatcacctgacaagttccattgtgcttgcttgtagtcattccccactcccagcttcagacccaagccaccaccaatctgctttctatttgtagtattgcctttctaaaataacctttatttatataattttatataaattatatataaatttcatataaatttttgaaattctttagaatggaattatacaatatgaatttttttatgtctgtcttgtttcatgtctgagagatacattttattatttccattttaacagaattataaactgaggcaaatggaggtcaagcaaagtttgcctagctaataaaagagagagctctatctatctgagttcaaagccctgttctattcactccttcttacttttgaatcagacctatttccagcctgttgggttggccttcgaaattttcctaaattttacttatcctttcatttatcttttagatctgtgctactctgtgcatttgtctttgattatttatctttattgttatcttggttaataaattaagtttgtgagttcattttcttaaatatagaatgatctgagatggcatattctttaaaatgaggtcttgagaaaactcatgcaactacactgatctttttagaaatttgcagaaaacattgttcctctgtccctcccctatttttgtgtgctatcttgaaaaaacaaaaatagcacacaaaaaagtttttgccagattttactttttagatcacttattttgccagattttatttttagatcacttattttagacttgctgcccctttagtagcatgtttatgttcctaagaatttttgaagcccacttggttgaagtctgtcatataacagagctgttactaacatgccctttcttggctctcatgaactctaaggtgcctggtcagttctacgtgctcagctggtggttttactttggtcataaatggtcccagcatgtcacttctccttattacttccttattttttctcagaagaagaaattaatagtatcagatgctctgtttagttgattttcagcagttgagcctttcatcttccagagcttttcttgccagagaatgtgaccttttaaaactgaaaagtaactgtcatgtactttcagaagtagcattttattcccgtcactgaaaccttgaaaacatccaaggtttaagctgagtagttcacagatgggttggcagatcccatataaacacatgattcaccctggatcagaagtaactgcagaagccaaaattacatgcattggtggcccattggaccgtgaagctgtgggaaaatgaagggggaaggaagtaacctgaaccttttatctctcagtctaccctcaaacacagtgatgatgtacaggttttgaacattgcaaacccagacttgcctatttacattcaaccccttctgttttacttccagctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcgggtgaggaacaaaaatatttacattcctgacaatttatgtttgggatattttaaaggcttcttggcaaagtggggaggtgtatgttttaagaatgtgggtgggaaggctagcaagaaataaccacattctttactaggagtgtatttgtttccaagatctaaattgaggttgaatatttagaaccaaagttttgagcaagcttagaagcagtttaaccagtgctgcaccaggaaatttgctattaggcgtttttaccaaatgcctcttgtagaagacgagaaggctcagaagtccttacgctttacacctggagaatccgtgggcatgagttcccatatactgtttatataaaacaatttagcatcgcccttccctcccccaaaagacctctgaattgtaattttacaaagaggttagaaatttatttgggatgaaggaattttgataaggagaaaaatgtatagccaaaacaaaacaaaacaaaaaaacacaaagtaacaggaaagatgtcttcaaaatgataaaaattggccaaatgttttggtttggttaaaattaaaatctcatcagctgctgttcatggggataagaaaatctaataatttgtcagaacattttgacctgttattttacactgtttgttgacatgtttgggatttttctttatcagagaaaggatctagagctgtatatcagcatagcaaaatgcctcttagaaatgacagatgatgatgccaatcggatcgcccaggttactaaggtaataacatatctttctataccttttttcattattgagccagaaattacgattgaataattgatttcagtgtttggctgaagcaagttttgcttcatttttgttattggttaatttcaggaaactatatttcatttacattgttgagcctcttgttcagcctactaatgtggttggtgcttaacaaatgttgtatggatggatagatggatgaataactttttaacccgatttctcccactttgtccttcacctgatcctatccttaggaatgaagaaggtggttgattgaaaagcaagcactattagccctgacacaggataatttatttcccacacccatgcccaagtcaaacgatgaatgagcaaaaagtagcatatcagtaaagttgccagatttagcaaacaaaatgcaagatattttgttaaatttgagttgcagatcaataatgaatcatttcttagtacaagtacatgccaaatgacacacttgtatttgaatggcagttttgcataccaactaataccaatggtctagagaactgtgagctcccttatagctggtggacttcgtgtcatttattttactttatggcaggtttgcctattcaatcagatccttgaatttctgcatcatatggcagtggttctcagaatgtggtctttgcataagtagcatcagcatcgccttggaaatgattagaaatgtgagttcttgagcccccatctaggcctactgaatcagaaactctgcagacggagcccaggagtctatgttttaattgtctctccaggtgattctggtgtatcctaaggtttgaaaaccactgttaaagaatatttggggccaggtgcggtggctcacgcctgtaatcccagcactttgggaggccgaggcgggtggatcatgtggtcaagagatcgagactattctggccaacatggtgaaaccccgtctctactaaaggtacaaaaattagctgggcgtagtggcacacacctgtagtcccagctactcgggaggctgaggcaggagaatcgcttgaacccgggaggtggaggttgcagtgagccgagatcccaccactgtactccagcctggtgacagaacgagactctgtctcaaaaaaaaaaaaaaaaagaatatatggaatatcaacattttggaagttaggttgttttaagcaaggagaagcaacataagaaaatagttaagaggatggactctggagcctcactgcttcagtttgaaatccagctctgcaatttgctagcaatgcgatcttggttaagcttcataagctctctgcctcagttcccttatctgtaaaggagagataataacacctatgacttagagctcttttgagagttcagtgagttagtccatgttgagtatttggaatactgcctgggtcaagataaggactcagtatttattatcataattattacatatgtgtaatgaattatatcctattattacattcatgtaattggaaataaagtatgtcatttacttcttagtacctagagctgaaggttgctgttactcgcttgagtttctacctaaaataccattcagaacattgtcactggaacatactaagtagtgttctgatgtccccaaaagagttagtctgcttcagcaaggtcagagttttctatttgtttctgaaaagaatagaggtagaggtaagaataagatagtggtagagaacacagactccctcagttctgtttcttactctgccacctgtagctatgtgaccttaatttaagcaagttgcttaaccactgtgcttcagtttccccatctgtaaaggtgggactttaatagtgatctactgcagagaattggtgtgagaatgagtaaatacagcagttctcaaatgttttagtctcaggaacactttagcttcttaaaaattgttgaggatgccaaagagcttttaattataagggtcatatctgttgacattttccttattagaaatttaaagactaggaaaacttttaaatatttacttaaaagcaataataagaaacccattatatatgaacatgattaataaaaaaatttaaagcataaaaatttagtgagaaaagtggcattgttttacatttttgtaaatctccttaatgtctggcttaatagaagacagctggattctcatggcagcttcttcattccatctgttgtgaggttgttttggtgaagtatgtgaagaaattccagcctcatacagatatgcaggaggaaaagggaaacgtgtgctaatagtcttttcacataattacggacatccttcttttacatttcaccaaaaaactcaacaacttgtagttccttttttaaaaaaaatattttttagactgagtctcactttgtctcccagcctggaatgcagtggcatgatctcaactcactgcaacctccgtcttcagggttcaagtgattcgcctgcctcagcctccagagtagctgggattacaggcatccaccatcatgcctggctaatttttatatttttagtagagacagggttttaccatgttggccaggctggttttgacctcctggcctcaaggtgatcctcctgccttggcctcccaaagcgctgtgattacaggcctgagccaccatgcccggccagcaacttgtagttccttaaaggttagttgcactgtagaatctgaaaccatattagtgaaactcatatactttgttacattaaattccacaggtctgttttacactttgggtcttttacccatgcatggttttgtaatatcatacattggtcatttggaaaatattgaatcactgagttttgaagatcttccaaatgttgacaatataaaataatcgtattgttaatagcactaccaatctcatcagaaaagctttttacatattgggaagctgccaggctcatagaagcagaaacaaattttccaaaaatctaattttctcttgaaagctcaaattttatcatttgggagcaaatactaccaggtatttttcttgaagtgacaggttcatttccttcagtttcaagaaaataatctgtcaaatacccaggttgaataaccatagtttttccatcaattattctttcaagtaaatagtgttctgtgaaaagagtggctatttcacagcctaatcttacacgtgttcttccttggcttgagaccaccatcatacctgggtatgcagcacagttcccatatgagtatttctcagtttgtcgcacagaatatttttaaaaatatttactcaagggccaatgtttaatggaactaataatttttattgtttacaaggatattttaagtgaaattggcttgtgaaaaaaaaataaacgtcagtacaatatacaatgaatactagtacactttggtgctaacataaaaatagttttgacctcacagaacctcttatgtatcttggggttccacagaagttctgtgtaccatactttgaaaaccactgaattaacacatgttaagtgcttggagtgatgcctggcacacagtaagtactgtatttgttagtcatcattttattattattgtttgtgtatatttactatatatcatcactgactaactcctgaacaaatttatggttttaatgaaggagcaggagatggcattacaaccctctattgtatgctcatgttaatttagcacacaggcagatgggtcatgtgctgcaggaaatgaacagaatagtaacatccaactcatcttttttgttttgcccttgccctgaaattctgtagctacttcagttaatttaatagtaactaaacaatttttttttttttttttgcagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggtgaggacaccctggggtgaacatcagaaacaggaatagatctgcctgctgttgcttttaagttgcacttgagttctcaacttaaaaattagtttagtgcttattgacacaggttaggccttctggtgccaaatgaggagtaacttggatagaaattaacagttatagctcacaacatccactttttggaaatgaggatggattctttcgaggggttttgttttctatttggctctgtagaccctcacagttacaaacaagttagctgcttctgcctgtttaacttcagtttcccaaaacacacaagatatcaattgattctgcctgatgatttcatgaaaatggcttttgggtagtcatttaacaaacaagagaaaacagaaacaaaaaaattaactagttattttacagaagaacttctctgggatgagaataatcaaatcctgccaccctgtctgcattagcaagcttgaagctctgctaatgaatcacatgatgcaatttttagaccgttttagacgttatgctttaataattactgaataagagcgctcccccattgctctatccaggttgttggtcatatttacaatttctggagactacattcaagttctgaatggcaccaggctcctgaggggtagatgtggctgggaagcttgtgcgactctggacaaattgcttatgcttctgtgcctggttttccccatccatctcttgtattgttatgatttttaggaaaaactgacaaacacgattgtaatactctgcaagactgtatcgccttaataccagcccttcaggaggcaaggcaggtggatcacctgaggtcaggagtttaagaccagcctggcccacatggtgaaaccctgtctctactaaaacgacaaaaattagctggttgtggtggcgtaagcatgtagtcccagctactcaggaggctgaggcaggagaattgcttgaacccaggaggcaaaggttgcagtgagccaagatcccaccactgcactccagcctgggtgacagagcgagactgcatcttgaaaaaaaaaaaaaagaaattttgattcatcatcccctgtggcagtctgaaacagtttttatatctgcatttgtgcctttccactgaaaaatgaacctatgatgagaaactggactttttaactctaagccaaaagtgtatgtatcaggaagaaatctagtaggtgtttcaaatgaagcatgaagttacatgcaataaactgaaataaatttgatgttgcctttggttccaaccagaaccagccagctctcaaatgcagttcccgtttttgaaacatgtccttagtagtctttactgtgctgggaatcctcttttttaaaaaacaaaattaaaagggaaaaaagtcaatattgctgctaatggaaatataatggctgtattttgtttttctttacatgtctttgggttaggtttcctctgtgatttggcataaattgggaacactgaagcaaaggagaactataaaaacaaataattgtcaacaattcaacattgctagttagttggcatgccagatttctcctagtgtgtttaattttgagagagaaactccaacaaatgcattttatcactagtggtcagggagatttaaagaataaattggcttttgaaaatcaaagaccaaaatactgttatctgatgtgaataatgtcaaagaactctctcacaggcagtcacaagtctcgggtattgcaagggaacatgaaactggttaatggaatcctcaccaggtgttctgctttagttatgatggttgttactgatctgttttacatttcaaaggaaaaccatggtctagtaagaaaatacccttttcatttcaggcgttttgaagagaatggagtggctcttggaactgatgggttatattagaaatgttgcttaccagtcaacatcctttcacaatacggctcttgacaaggtaaaatctagaggagtagtttatagcttccttaaaatacagaacttatattaggttggtgcaaaagtaattgcggttttgccattaattggcaaaaactgcaattacttttgcaccaacctaaaatatatgctcccaaaagaggagcacgttgctgtttgcagcttttctttccctctttccttttattttagacacacttaatgattctctgatgccgcaagaaaactggtattcttaccaagctcttggagacacccaaggctgccctttgagaaatattttcaacaaaatatgtttcttgacagacagaacacaaaggacacttgggagagagagaacccaagctcctgtgtagctgggattgatcccataaaggatgtgggaatatagggctctggcctccacactggccagcatatggctaaaaatgcctgctttgaagaggttcctggagtgtatgcagataatcttatgtgtgccaatacttatgtgcatgtgtgcatatatggaggggaatttttatcacacctgcaaaattacctatgactcaaaaaaagtaagaaccgctagtattaggtttgggtaagtttaaaaataaaagattaataagacgaagacagctctttcctgctttccttcattgtgttgacttagctggcagctgtgcattttgtaatagcagaattttttttctgtaggcatgcttcatgagtattctgtttgctgtgtgagtcaaatttgcataacctgggatgttttttgaagttctgcccagtttttctgaagagttgtatgtctttttgaaattttaatttgtgagtttaggaattttaagagattaggaagtactttttaaactttttttgaacttgcgtgatctgtcctctttcttctgatttcctaagtttttattaactttctctgttttcttacaaaaaccttaaaacactgagaaaatacagataagcagaaagaagtgtagtttaaatcacagtaatccaactactcagaggtggctcctataatcaccatttctatgattgtctagattagtctgaaatctaaatggatagatcctggacaggtgtttaaaatgcatgaagaagctgggcacaatggcacatgtctatagtcccagccacttgggaggctgaagcaggaggatttcttgtgctcaagagttcaagatcactctgggcaacatagtgagaccccatttcttaaaacattttttaaaaaaaatgaagaaagacttgctcaaaagtagaatcagagtatacatatttttaaaaattagttttgcccacataaccataaatatttcttcattttgtaagctctttgaaaacatcaaaacagaggaatgtttggatcttgatgtgattaggaattgaataaacgatgtttctcctgaaatgttagagcgataataatgaaactgttgggtcttctgccttcacataaagggacttcaaaaatcttctaaagccccaaaatgtatcttcattaaacatggaaactgagtttactgttcagttcagttcctcttctgggtgggggtagggcaggagggactggttgggtgaaggggaagatgacattgcctcacgacaggggctgtgtatgtgaacatgtgttactttgaattgttaaaaaatatgacctaacgtcatttctattttcatcgtaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaaggtgaggctggcagccacctgcttagcagggcaggcagccattgtctcttcagcagtttctactgtagaattgaggtgggagttaagtgcgtcttgaatcacaccacagactttcctacccagccccatatctcagccagatgcagagtctcagagattgaggctagcccaggctcggggcaactgctgattaaacaacaaggtggcagcttgcttacagctgggagtgaggtggaggaaaagtccatacttcatttattgaaggcacttgttttcttgatcctggggaggaaagggtgagtatgtctcagagctcagaatctcaaggtgagggtcgacgggaaggcaaattcaggattgcaaatcgtgtgataagtaagatacagtggtgatgagcaagggaaggagttgatcaacaatgcctgggtgggtcaggaagttttctgccaggaaatgtgggtcgggagcatccatcttcttgtagcatctttaaggttccccatagcttattccattgcacagatatgctccaggcacccagtgtgccctggtctgtgctagatgccaaacagagctttgtaaaggtctgatagtatcacccttgccctcaggaaaacctaaattgtttagtttgctgttcagtctagttcctcttctggagtaggggtggggcgggagaaggagttgggtgaaggggaagatgacattgcgtcatgttgagggctttgtatgtgaacatgtgttactttgaattgttaaaacatatgacccaaaaggaaacattttttggtttttaatgttgaggttccccaggctactagctgttctgcaaagcataactgtgcttactgtacttctcattatatgtttctgacctgtccttaatacagttggttgaaagattcttttttgaatctcatttaatcaaaactggatttttatgaagttgaaagcttcaaactaacttttttttgcttattcttgaaatctgaacattaatctttaaaaacatttctgaactgtagacccatagtttagctatgcacaactccaccaagtatctcaactaaaatgccttttatttttcttaaacctgataagcattagtattgctgccccaaattttgtgctttgtgtcccatttaaaatcaaattttggctgggcacagtggctcacacctagaatcccagcactttgggaggccaaggcaggcagatcacgtgaggtcaggagttcgagtccaacctggccaacatgatgaaaccctgtctctactaaaaatgcaagaattagacgagtgtggtggtgtgtgcctataatcccagctactcaggagactgaggcaggagaatcgcttgaacgcaggaggcggaggttgcagtgagtcgcaatccctccgctgctctgcagcctggctgacagattgagactctgtctcaaaaaaaaaaaaaaaaaaaaaaatttaaatgtggtcttcccatatattatttctggactgggataccacgttccctttggactacaatgtagacctcttgcattgattatatatttgtagtgcttgacttttttgcttatcggttggatattatagcacaaaactgagaaaaggaaaatcaacaaagaaaaaaatttttgattaaagcagggaattaggaatattttctttttctccctattttactctttcttcaatctagcttctatatgtgaaactaaaatgcctattacctatcaccaatgtatgtgtttttagtgaaccaagattggcagcattcagtcattgattaaattaccctgtatctaattcaaaaacaattcaggctgcatcctgagagatcagccaaactcataaatactatgagtttccacctcatttgcaggatttattcatggttaacatgcttggctctacctagtgaattattttatgccatttctcttgcatttcaattttctgtttcatatccatttgggcacaactgttctcatctacagaaacatattttatttcagaaatgggggcttatatctgatgtgttttctatttactgcccagcctaggagcctagaccaagctgcacacagaaccaggtgggaggcagcatgatgcaaagaaagagcatagggctctgaagccaagtgtacttgggttcaaatcttaactcggctatacattgagggtggacttgggcaaggtttttaatctctctgggcccatcagagtgatgagagataatgttcctggcacacaggaggccctctgggcccatgtctacctccctcttaaaacctgtatcagcagccaggcatggtggctcacacctgtaatcacaacactttgggaggccaaagcagttgaatcacaaggtcaagagatcgagaccatcctggccatcatggtaaaaccctgtctctactaagaaaaaaatacaaaaattagctgggtgtggtggtgtacgcctatagtccccgctgctctggaggctgaggcaggagaatcacttgaacccaggaggcagaggttgcagtgagccgagattgcgctactgcactccagcctggtgacagagcaagactccatctaaaaaaaaaaaaactcctgtatcagctctcaaggtattcagcagggaagtaggtttgactttgccaggtcatttaactaaatgggagctgtatccaactttaccatatcttatgcttggtccctgtctcatctcctccacctggggaaggtattgcctaagaactgtaatcccagctactggggaggctgaggcaggaaaatcacctcatatatataggtccaagggaataactgttcttttgctgatggtaggattctcttctttgacactatttttcatttttaccctagttcattgactggctattcagcatcatggaaagccctaaagaagccctctcagcacagtccagggatcttttgaaaggtattacttccatgttttatgctcaacataggggaaaaaccattattgttgtctgtggagcagaatggcattctagtggttgcaggttgagtatctcttacccgaaatgcttgggaccagaggtgttttggattttggatgtttttggatttgggtatatttgaacatacataaggagatgctttggggatggaacccaagtctaaacacaaagtttatttatgtttcatacataccttacatacatggccggaaggtaattttatataatatttttagtaattttgtacatgaatcaaggtacttggtgttaagtacttatgtgtggaattttctacttgtgttgtcatattgaggctcaaaaagtttcagattttggaggattttggatttttagattagggatgctcagcctatattggtttctgaaagagataatctggagctgtttagtgtggcattttgaaccagaaagtagacttaaaaagaatgccagtccctttaaatttaccatttatttaaatggttttaaaatgttttatggtaatagtaaaatattcttttaattaaaattcagaaaattcagaaaactaaaaagcagcaaagagaaatccagagtcccattgcccaatgacaatttttatattttccataagaagttttttcctgcttctgtgtgtgttgtcttacatatttataatcatatacaattgaaaatacacatagctcaaatactgcctttttaattttaacattctttttcaaacatctaaacctgttcttacactggctttataagtagtgtttttaatgagcttcatagtatcttgccaggggaactagacacttctcctactttcaggcatttaaatgatttctgtcttttgtacttctctaccgactttgttaactatgactgtaggatccacaaacatggaagatctttccgtaaaacttatgtagattattttactcagatctgagaagtcatttgggcattggccgtatggactacaacagcttgttcttgtccttcatgtctggtgatctgggggtctggagcctgccagcagctgccactgaaactttcaccttcagaaagttgcctgttggcctattctgtgataatttatctggtcagcctggagtcagtgtatgatccatattttacctattactatggtacagtttattggttgccaaacaagtaagaattcattggttgtaatctgtctcctcaaagtggtgggaggcatgtgtgtgctgcaacagtgctcccacataactctgataaaccacagaacttcactgaaaatcagggctgtggtctgacatgttttcacattatccatccctagagacttgctgctagggcttactctgtttgacccatggagtttgtgctcatttttaatggccataataacgttggttgctccaaagatataccctcttaggttacaaagataacaacgcatatggatgaggaaagcaatcattcgggccaaggaagctcatattcacttgattatatagtaggcttattagattcacatacaataattgtgtaactctggcttacctacattccttcatattattatatttcaaataaaatatcaatacatttgtattaatattctaaaataagatataaaaaattacttaaaggaagtacacagaacttcctattttaaattgatccctgagggacctgtgacagatcagaaatagtttggggacagatgttcagatatactttagtatggtcatacttgctccattgagtacatgaacctaactttattataggttcaggttattcattgttgttttttatcattaagtaaatgtttaatggaaataccatattcatgtagaaaagagcacaaattgtgaggagatttttacaaagggaacacagccatgtagtcagcaccctcatcaaggaaaaaaacatcaccagcatcccagaagtcagctttcattttaattctgcagaatttcccattaactgattgcagggtaacttaaaaaaaaaaaaaaaaacaactttccccccaacatttataaatggttttctgccattaaaatcctgccaaaatatcgatggaactccctagtcttgaacattagccaagtgagaaaaagacaaattctgttctgacacctttttgatcaaaatgaccttttcaaatgcagccatacctatattttgtccccttagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttg

SEQ ID NO: 1118 - DNA, 126305 bp, Homo sapiens; identical to SEQ ID NO: 1116

SEQ ID NO: 1119 - DNA, 83101 bp, Homo sapiens
tagctacatccgtcacctgacacggccctaccaggaacagccgcgctcccgcggattctggtgctgctcgcgtccccgctcccctattccccttattttattcctggctcccctcgtcgaaagtcttccattcttcaaactagattatttaaaaatgaaaaaggaagaaaggaaagcgaggtcatctcattgctctatccgccaatcaggaggctgaatgtcagttttgaactaaaagccgctccgctcctcttctagatttggaaaacaagcgaaattaaactaaaccgctgcacgcctctgacgcgacatctggacacggcgcggcgctggcgctgccggagctgtcgacccggcctggcgccggactaggtaggtggagtcgcacccgggggtcccagctgggtccgggcgcccattcccctcccagctgcccgcgtcgccgagggcgcctggctgggacaagcaccgagtcctttgtgtctagcccatttttattttcggttttaaccttcacgacagccgcggagcatctgagcgcttcttcctctttcctcttcccccgcgctcccctcccctgctggccgctcccctcctgtcgccgcgtcctcgcgtagaatggttgtcttggcgaccgttggccgctgccgcctccacgctctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcctcagaaatgcttcccttttcaggcaccctcataccaccgtgatttttttctttatagcacttaggacgaagagattattttacttatgtacttgtttacttgtttgttgtgtagaatgtcagctctatgggaaccagatccttttatgggtcttcctctgcacctatgccacgcccccagcattcccctcctaccaccaccttcagccggcctccgcctctgtaggggggcattaggttttctgtcccacagaggaagggcgctttagaaagggttagttcatcctggaagaaaaacgatgtcggatgccagcatagtgtcatttaaagatactggaggaatggagtgggagcggtgagggtttcttgggcctagacaatgtaactagttgttgcaataaagcatggtggggaaaggagaaaaggcacgtattaaacatcttttgaagtcgctatctatatcagtcagttctccagggaaacagaacccattgtgtgtgtgtgcgtgccagtaccacacatatgtatatgtatatacacaccgtcatggggttgcttaacaacagggatacattctcagacatgtatctttaggcgatttcattgttgtgcaaacatcatatacaaacctaggtggtatagtctattatacatctaggctgtatggtatgggctattgctcctaggctgcaaacctttacaacatgttactatactgaatactgtagataattgtaacaaaatgtagttttatatctaaacacatctaaacatagaaaaggtagtatgttgtgctacaactttaggacagctatgacatcactaggggataggaatttttcacatccattataatcttatgggacaccaccaatatgtgactgtggttgactgaagcatcgttatccagcacatgactctgtgtgtgtatacaattttatatatacgtacattatatgtctacacacacatatgtgggggagagaaagagagggagggagagagagagagagagagagagaaagagaaagagagaaaatacttattttaaggaattgtctcagaaaatggtgggggttgacaaattggagacccagggaagagttgttgttgcaagacttgaatccaaaggcaatctggaagcagaatttcttcttccttgagggacctcagtcatttctcttaagctcttcaactgcttggatgaggaccacccatattattgaggataatctgctttttcaagtctactgacttaaatgttaatcatatctaaaaaatacctccacagcaatatttagactggtgtttgactcaaacactgggtaccacagcctagccaagttgacataccaaattaactgtcacattatcccgtcatgcctgaggggttctctgaccctcagttttctgaggatcaaatttaaattgagggatctatctttgtttattggagccatatagctcaaagtataatcattttctctccacaggaactagacctagggataagggtaattgcttatttcagaggaatgccatctgaataaaaggataattatatagtaagctctctgttcaaaaaatgtaaatattaaagtttgaacatctaaattccatcttggtttcccccactgccgctgcccaatacctgttctctttcagttgcagtatgcaggggaattctaagtttaatattagtctcagcaaaatacaatggtgaagatgactctttctagcataacaatgggtatgtggtattccaaatacttttggaatgcggagtgactattggctatgtgctcttcaaaaaattaataatgaagaactgagcatgtaatttcacttatattacttattttatcctcacagtggcctttcaaaattgggattattactcctgttttacaggtggaaagaatgaggcctagaaaggctcaaatcttgaacacttcatggccagcaagagccagggctggaatcatcaggcaggcctttgggttacaagccttgtgccttttctgttgtcccaaaggccagggtcaatagggagtgagttatctgtgggtcacttatgcagacagaatcactgaatattggaagtttttggggttctcttccactggcctaaaaacctgagttaattgagttttttttaacaggggtaaataattttctgttttagatcagcaaattcattccataggcagggataggggagaaaaatcttactgaatatcccttgtcttgttctcctcctccccaaacttaatgtcctatgacactagctttatcccttaggtaactcttgattatccaaatttcatgagaaactttcctaacattgcacatgctcaaactcaaaaccccaaagtcataagaaaaaagataacataagcaagaataaaaaacaattatttgatcatatatgtcaaaagattaattactagactatataaataaatacataatccagtaaaacaacaatccaataaaaaaggcaaaggatataatagtttatagtagaatatgtgcaaatagtaaaaaataaaaagataatcttactcattaataaatgtaaacagaaacaatggcatataaccacaagtgtggcaaaaagaaaaaagactactttgacaaagttgtcaggaaacaatcactcttactattacaacttggtgtaattgttttgaaaggcagcattacaatatctagtcaaaactgtatgagaatataggtaccctttgactcagctattccactattttaagtatgtaaagacacacacaaataatgtatggaaatatatatacacatatatactatatagtatatatagttcatatgtatgttatatgtttgtgtatatatctatatacttatatacaccctttgactcagcaattctattcctataactcatgtatgtaacatatataatacatatctttatatacacatatgtacacacatatctgtaagtatgggaagatgtatacacatgtacacatatatatacatacatatgtatatatgtattttatgtatggatacatatgtatatatggatagattttacacctacagacacatttagatatgtaacttcagctaaagcaattcactcctatataaattgctacagataacttgtataagtatgcagaaatgtttctttatagcagtgtgtattagcaaacaaagtgcaagaaagagaaaaatgattgacatgcttgtgaggagactttttttgttgttgttgttgttagggctcattcataaaataataaaactgtgcatccataaacaataatgaagcacatctatatgcactgacaatggaagttgtcaaagatctattgctaattaaagaaagcaagtgacagaatagtatgatcccattcatgttttccaaatatgcatgctgggggagagatgtttgcaattatatgtacttatatttctggaaggataattaaatatttgtaatagtggttacctttgggtagtaagaatgagggtgggaaaaatttcagatttttgcttactactttttgctttctggactgtttgaaagtttaccatgagcaagaattattaaataacaaccacaggaatattggggctcaaacctagagattctaattttgtagacctggagctgatcaacaagtctaaatgttaaaacatcctcacgggtgattctgacatggagccaggattgagaaacaattttctgaaatggaaggggttttaaacttgttgtcctcaaatgactactgaggcaaacaccattcttatagacataagacatacttgggagcaaatgtataataaagtggtatgcttccctagaaaggggacgaccttaaatctttctgtttatggtggtatttaaacatattaaaaactactaattttggaatagtcttactgtgataagtctaactatcaaaggcagtccagagattagcaaataatagaggatgatcaaatgtttttcagaaaatattataggtggcactttggcaggagattctgagaatggtgagagggtgcctctgtgccctaggaaaggtgatagagcttagaaactcagaactcagatggaatgaggagccatgccatatacatctttacaacagtcaccctctagaagaaaactctgtgttgacaataatctgctgacttgtctgtgggtttttgaacagaataaactgtttcttcttttatgtttgtgtattattgcttataaatatattctaaaatatataataacaaacaataacagtacttgcagcttaattaaagaaaaaatgcaagtatcttatttatactaagagaagagagaaacccgaagaacaatggattatccttacatatttggtttgggattacattgagagctacctaaataccagacactcattcttggtcctgactcctactctgttatccatagctcagtacctagtatctggcgcagaaagaagtggaatggaattatcagggagacccagtttttagccaagactaaaaggttttagccaaggggatggaagaatttgtgcatagatagacggcagatgggaattcgtttaaaatggaatggagacccagaggtcacataagacagggttcagaggaagtagccccaacaacatcataatagagaacattgataatgagaggatagatagattatgcatttggggaggaggccaaatatgagaaataagacatggtttacttactgtaattggtcttaaagttttgagtggaactctgttgtaaaatattttctgtgccagagctgactccatatatctactggaagtctaatgccaggggcttctgagtgtgaagtggattaataggtgtttggggtcctttgtaaacttctagtgtaatgtgaatagctgtgaggtagtcagtgtgtcatcttaatacattgttcttagttctttttccagcaaactcttttgttttacatttagttcacaccacaaattagtaagtcaggcttggtgctttttgacccatacattaattttcattactgtgcttaatatacaatccatgccaattacatattattaattagtggcactagtattagttcatattttcttttattatgtaattaatagggcctatatgtgaaagttactgtgtttctgtaaaatgaagtattctttttccttacgcaaggaatgacattaaaatcttctgagtagggaatttaagaggcaagaaaggagtaatttcatttggatagctgaaattgagaaacgttttatagaaacttttcaggtatgaaggatagtagtagagatgttacatgagttagcactcatatattgaattagttaaggaaccaatgtgggaatctaggtcttctatcttccagtcaagtccttgtttcacttttcttcattccctctttctttcctgtcgttataagtagaataggaaaatattgaaagtattgaggctcaactgttgttgcccctttaagtaatttctaaaattaaaattgtcttattttcatatatgtgtgattgtgtatctaggtatctctttgtagcttagtaattgaacactgtgaactacaccaacctaagcattattctccaagttttcatcaaataactagacagtttctgttaatactgaaaatctagtaaacgtgtcagaatttggttatgattagttgctgacataaaacatgagggcagacctcactgtactttagaagatactggctttcacatttgccccagtaggtagttcacatgagtgcttcttcagataatgtctctaagttttgcatatcattagttctacttgctccacttttgatagagtggcaatgtattgaacattgtaaaaattatgctctatgatttaaaaaatccatctctggtaaagcataaaatgagtatatgttttactgtttaaaataattgaggggtaattatagaatcagcaaaaagaaaaaaaaaccctactgactattacatatcaatgcacacagtgtgttaatattttcaaaaaagggagggcaatctcagtgtaagtgtaaatgaaattagtttttgtatatatttgctgaagatcagttacctagcttcatatgataaattatttggtgctggtcacaatattgtgcttgccatattagggaaataaaatatcatgaaagtattcctaagtatacattttcccagaggcgtttggggttttatcagtctcgagctctcctcttgaaactgtttcattccttagttatgaaattactaattttaaccatttaaggcataggaaattttacatagattttgctttaacagcaaaacaccctttaaaaaattcatccacttaggtgaaaaataaaagataaaaatgaagccaaatgaatgttattaaatttataaatttatttaactttccagatcttcttggaataaatgtcaggtagtagaatttgtacaaaccttggtaatgtcttaggtttagatacgaacttaacaggtatatttaattttctgtattccacaatggagctagaagcaggactcatgaaaatagtaactatatgttttgcatgtatccttcaaagtgaaatccttaacaaatttaacagtatatattaggctgctgatgaaacagctaaacctgtctgccaggtggcttcgaaaatggaattaatttttacatggcattgataagttactatttcaatacaaccaggtggtaattgatacccaataatgtttgaggtttgctttaaataaaaaaaactaacaaaacaaacaaaaaaaacagtgtaatatagtactgtgggatccacaataacattttctttagtttcccttaatatcaggttgtcattaggaaagattccacaagttatttaaaccagaaatgaagtaacatgtttcatatctatttcaagggataatttttcatgacccagtataatgcaactagcaaatttaaacatcttggaatttaagatatagaggtcaaattaagggattttataaaccaaatgggagattttaaagtatcaactgacttcttttatatagaatgttttctaataattgtaaaatactgtaactttaaaaatattattcttgtagcctctaatgattgagtgcttaagtgataactagaaatatattttctgtccctgtgcttcagtttgaaaatggaggttccattatctttgttccaaaaatttgggtttttataggtgtgttggggggggttattctccatattgttgacattttaaaatagttttcaaacaaaccgtttatatttactagaagttagagaaagaaaagccaccttaggagcttacaagggagatcattgtgtatttctgcttttttttaaaaaaagttatcttcatgtgtatcattcatgattttggaggacaagctggtgcaatgggaagaaaagcaagacaaccataatcagctgtggaactagatgcacttctttgtgcatccatggaatgaatatcttgtaacctttggcaagttacttgatatttctttgcctcattgtcctcatctgggaaacaatacctatctctcaggtttaaatattaaattaacaaatatattttaatgcatacctggtacagattatgtgtcaataaacatatcctttccccaataacatatgctctgattctcaactaactttccccagtaatatgttcattttgggaataggaattggtagagaagtaaagatttgtgtattcaactcaaatgtactccttcttataagtctccactctcaaatgacttgtttctgttccttttttctcttttaaatgtgtatctggtagaatgagcatttagaagcataatacatgtatacactttgtgtttaattttctatggcataagtaagcagtttttatgaattgctggtattgcttatgagcaattattacaaacattgagagaagggaacccctgtgaacctttaacatttctcaggagttagtggtaaacccatgaacatgtatttttaaaccaaattacccacctcttggagttcaatctctgttaattctttattaaagtagtgaagtatcagttgttccaatgatataatgatcaagcaaccctggaaattaaatcccaaagcagtgcacctttagtttgttcagtgatagtaggacatcccacgagccatcatatattttcaagtttttatactcaatctactttttcagcaatcttttgggaactatcccaagataatttactgcataagtgcatctatcttctaaaagacatttggaatatttcttagtctgacctctgcaccctgagacactctataaaggaaacaatcagaaaaatttaacaaagaaataaataggttaagaagaaagcaatctaggcgtttgcactgagtttgcaacagtgccattgctacatttaagagctgtagttcttcctcacattttaactgagagccactagttatgttacttaaaatctccccattaaataagacagttgctgaacaactaaaaagtacaaaatatcacaaaatcaaaaagtagcaagtcataaggggatttccgcatcctagcatgtgtgtgtgtgtgtgtgtgtgtgtgtgtgaaagaaaacgttacagttaaccgttacaattgctctcactccactccaccacctcatcctgtgtagtctgcctgcggaacccgcgggaatctctcctcagtgtagtaagagcaaaggccagcatcctgtgcaaaggtgctctgcagcgtcgtgatccagggattttagcatctgtcgtcgcttgcacatcctctcttacccctctgctatctggtggagttgggcgagggtctccagggcttccagagagtgtcgtttacgcatgtgacttgccatgcgctcaaactaaagcgccgccggggacttactgaagcccacctcggccctcctccactttgtcctcagtcttcaggttttcctttctgccgctagggcctaagttgtgggttcaccataactcctcagcagacattggagtgaacgcatcgactgccgtcacccaagtgctaatcactgccttctcccactcagcgctggagtgggagattcatccatcggaagattcgtagccaccaggtccagtcaaggatttcatatgcactttccctcagaaaaccctgaaaagcaaacgacccctggaatgtcacacactcctaaatatccctggaaatccgcttctctgtgtttcgcttcatggtgagtgtcgagggccagataagacaaagaaaaaaatgtatggaaggttattcccggtcggctcctccttcctgtgagtctcagacaggcttgcaggcttacaggctttccgccgctccccgttggcagccttcatcgaattaggtgggtgggggtgggaaattgggtaagaaaataaagtcgttgtgggcggctggggaacctggcgtcagtcccccgtggctgtgcgcaggtaccctgcaacgtcgcggtggccccgctcctcggccaagtccacgggcagacgaccccaggcatcgcgcacgtccagccgcgccccggcccggtgcagcaccaccagcgtgtccaggaagccctcccgggcagcatcatgcaccggtcgggtgagagtggcagggtctgcgcagttgggctccgcgccgtggagcagcagcagctccgccacgcgggcgctgcccatcatcatgacctgccagagagagcagagtggtcagagccagggtgggggcaggtatgggagatgccggccggggcaaggcaggtggagccatttaaagaaacacctaattgcaaagttttcacccagtgcagaggtgttcaggtctctgatgtctggtgtttcttcatttgctgatgcaatccactttcccaccccaccttcaggttatactcagtacaaattaaatgccattttattctctaaacgtgcagagacaagaaagttgatggtaaagtgatgatcatcattatggaaaaacaaatcttgatttccattggaacatgggaatctattttgttaaatgatttaggggcagagttaaatttattcggcttttaaagttttaaattatttgccttgctgacccctcctccataatccaggtctacaaatatttattaggtagtcaactactgtttgttagaagttgggagtaatggtttaggggagaaaataaacaactaagtttttttctttcttttttttttaatttatttagttctcatagcaaatcccgtgcggaaggcttttgtttgtcatgtgtctgagctcataactggcttgtagtgtgataatttgagccaaagttggagattagaagggaaaagtaaattaaatcatgcaaaatcttataaaattataataaatgatttttccttaacagttcatcattttaaatttagactataatatttttaatgtaatataaaactaactatatttgtatactacaggattttataatagctaagatttaaaaatgttaaacagtaaatattttgctatataaaaagagcttgggccaggcccagtggcttatgcctgtaatcccagcactttgggaggccatagcaggcagatcacctgaggtcaggagttcgagaccagcctggccaacatggtgaaatcccgtctctactacaaaaaataaaaaattagctgggcatggtggggcgtgcctgtagtcccagcaactcaggaggctgaggcaggagaatcgcttgcatcctggaagaggttgcagtgagctgagattgtgccactgcactccagcctgtccgacagagtgaggcctcatctcaaaaaaaataaaataaataaataaataaatagagcttggatgttagcagtcaatcaggatgatgcataacttagaaaaaatgatgttttgcaggagtaatcctgtagcagccatttgtgtacatgaacattatgaaaacatttgctgtcatatttaaagtcaattataagacaatttttggtaactaaatgtctaaaatcgagttatttgttatgggtttatgcactttaaaatataccatttaattgaaaggcagtatacttctcatgttttgttggcttgtttcattaatattagaaatgttcatttcatctcttaaaaaccgtgataagttatatctactagtgatgtaaggatattttacatagaaaaaaaggggaaaatagctgctgttagtatttcagaaaatggtgaattacatatataacttgtttttataattattaataaaattttaagtttttaagatgcactttacaatatttttgctcctttaaaaatccctcatttgttataccattattctaagaattcaaaagaaatgaacacttctttaaaatctatactattaacaagatcccttaatattagcttagttttagagggtgatagtgaggtgagtactgaatatgaccactagccaacggtaaagtacaaaagagttgtccgagattgtaaaagaaataaaaaatatcagtactaattaaagcaggattcgtacttaaacattgaataagtgtattttaacaatgaagataaagatgcattatttatgaagatcctttgccattcaaaaaggacctaacagttgctgcaggaatatttttgtaatctgggcactgagtatgataattaaagaatgagaaacctatagaactatatattttttctcttatgcatcactcataagacactgctaacataaaaggaactaagtactgtggttgaggaatcccgtctcattctcaattaacctctatgagaaaacaatacaacagatttcatatagtagcttagaagtttacattgattttttccatgtactatgattttgtagaattccttaaatccaatctagaatgcgtaacttatactttacttatctttatcgttgaaagcagacagacaagataatcttcttccctaaataagctttccttttctccttttctccccaattcagtctattccttgcatctctgatcatgagatggcagaacaaaaaccactaaaaaaagcttaaacagtgggtttttcaatgtctctctttaggatttttgctgggtaaaagcctgttttacgcgtggaatgcacacctccggccaacggagactcctgtacaaatctacatcggcgatctaggttccagccccgatccgccgaggccgcgccccgcgttcgcgcgccccctgccggcgaggccctggggccccagctacctggatcgcgcgcctcccgaaacggttgactccgttgggatccgcgccggcttccaggagctgtcgcaccttctccactagtccccgcgccgcggcgctggccagaccctcatcgctgccgcccccactgggcatgcccttgttctcctcgcgcattccgcagcccccagacgcgcagcggcccggataatccaccgttggccgtaaacttaacgacactcttcccttctttcccacgctgctccggcgcactctctccttcctaggagacctgggctcagcttcattaccctcccgtcgtccttctgcggcttggggccccgtgcagtggccgagcggccggtcgttagctccgggcttttcctggcgctcaagaaccagcgggcgcgcctggattgcttctgggaaaaagcgcctagcgcggacgcagccgagctcaaagccgctctggccgcagggtgcggacgcgtcgcggagtcctcactgccccgcctcgctctggcagagtggggagccagccggcaaagaattccgttttcagctgggccaaggggccggcgtctccccacccccttaggctccgccccctgtccgctgtgatcgccgggaggccaggcccgggccgacgcgtcacgagggcggggaagcctgcccaaagatgctaggacgcatgcgccagagactgggccagggagccgccaggaatgctggctgcactgctcgctggatgtccagtaaagccaaggctaatattttgggaatgttcaccactgccctcagctcctaatccccagtaggcggagcagaggatttctgttccttcagccagccagttggtttcactgtggagacgttggtggctcccttgtgaccgagagaaagtcattcaaaataactccgtgtttcttaagatgtctgaaagcgacagctctgcacctgtcatacaagttaaattcatccccaggcagtacttgggcttcacaagtttcataacttgtatcaaacttagcaattttctcttggatgtgtctttctgtttgaattagtcaaccataaaaatagagaaaaatcccgagaatcatgttttgcgtgtgctttttaattctttccatttttgcattatggatacaacccttaaaagagaaaaaaactagttcgagattgagagtggcaacctggcacacataagacaaaaaaaaattatactttaagaatctgagatcccagtttcatcatatttgtacagtaaatctttgtttgcactcttacctatttaaacccactttgtcaggtatcttatttttatttatcatgagtaataaaggaaatttatgcagtaataatgaaacatcataagagaggggtgtggtgctgggcttgtcattaaacaggctgaacctgtcattaaattctcttctgaagatttaaatgccaagtgctttttttccccttcctaatcttcctaggtgagtttgaatcaacatttattacttaaaatatttaaaacatttcagcggatgctacattggataggaagagaaccgcaagttatggatttgttgcctaaaaactttggtgaggaactgcataagtggacctctcctaaaagtgaacaatttttgtttacagaatcattttggttcggagtgctgaggaagacaaagtcttaacaggagggcaattgcttgtgtattgcaaaatgagagtcttcacatgttttttttaggataccttagctctgactcctcatcccccaaatccctgtagaattaaaaaaagctctttcttttaaaggcagtggaagtgccaccaccatggaagtgctggttagggctgaaaatctactgacagagcctcaacagagctgaaatccacctggacagggaagggaaccgggtagcattaataacaatttctttttctttcccatccaacccccatttcctagtcttcagtttcttaatttctctaccttttactcttatgctcttgttttgacctttgagtttctctgaaacttatcagaaaagttaggacaagatagtctgacccaattcttgagccattttcttaggtagtaaatatgtcagaaaaatgaaagctgtttggagttgataaggaaatggaagataatgtttttctttgagggggacataaagaatggtgatagggaaagaaccaatgactaagtaaaatgactgagaatcttgcacgaggcagatgtgtgagcttcgcgaagcaagttgactgaatgaaaaacaactttgggtagggaaaacgttgccgggggcattcgcgcttactagcaccacggacagcgctttgcttatactcaggcctgggtggtcctaaccagctccagacagaattctaaagcttcacacttgatcttccaaagccccttttctcccgtcaaatagaaaggacattatggaagctcaatgaatttctttgaaaaaccaacctgctcaacctggttttcaaatatgattggattttatctaatattctctgtataaagaatattatatagtctatatttagaagacgagaagagaaatcaaacttattgtgtactctgtacgaagtgctttacagctgttgtttcatttaatactcataaaactcctctgtggcatgtgtccatatttcaattttacagacaagccaaaaggatcagagaatttgagtgacttgtatactagctaatcattgttggaggtgggtataacttttgcgacttcagagtctttttaccctttatactacatagtgttttttttagcagctgtcatggtaggcttaactggaaaaaagtaataaactggcttataattatttttcagtctacactgtgttttccagatggctcacctcacagcacacccttaccagacttcaaagatgacatttcacatgtaatacaatagcacatttgtcttggacaatagagtgagattatgaaacattttacctctccttgaaacccagctgtctctagggtgaaacacaatctgttgttaatgctttaaacacatttaaaagatgaagtggatgggaacatagtgggcagctgaaacttggaattgtcagagccatgtcttttaataaggtggagaatttataattgagaagaaagaaagagaaagttaatggtaaattggcatagaattttggaggtcagtagaagggaatgagtggcatccattccaatgttgcacataactcagatcactagtaataatatttttatattctagttggtgaaattgtctgtatatgaccttgatatagaagtatgaacagatctgccatcctctttttcttcagcgaggcagccgagctgcagacacagagatgcagatctttgtgaagaccctcacgggcaagaccatcacccttgaggtcgagcccagtgacaccattgagaatgtcagtgcgaaaattcaagacaaggagggtatcccccctgacaagcagcgtctgatatttgccagcaaacagctggaggatggccgcactctctcagactacaacgtccagaaacagcccaccccgcacctggtgctgcacctgcgaggtggcattattgagccttcactcttccagctcacctagaaatacagctgaaacaagatgatctgccataagcgctatgctctcctgcacccctatgctgtcaattgccgcaagaagaagtgtggccacaccaacaacctgcaccccaagaaggtcaaataaggctcttccttcctcggagggcagcctcctgcccaggccccatggccctggagcctcaataaagtgtccctttcattgactggaaaaaaaaaaagtatgaatagaactggttgactggccaagagaaacagcgacctaaccttgccctcatttatgcacacttttgcatatgattaggactaagatagtgtttataagtgagaagagaaggaaattcataatcacttttggggctttttcaaattttttatgaacacaccttcccaccaagaggtttgattttctccattttatgagttgggtttattgctccgtgatccacagtatatccacttctatattcccatgtatttttcaagattaattaaatggtggacttgttcatcattttagtatccgtattagtttgctagggctgccataacagaataccacagactgagtagcttaaacaacaaatatttattttctcagagttttaacttctcctgaggcttctcttcttgacttgcacatggccatcctactgctgcctcttcacatagtcatccctctgtgcacacgtgcccctggatctcttgtgtgtgtccaaatttcctcctcttttgaggacaccagtcagattggattagggcccaccccaatggccttattttaacttagtcacttctttaagggctctatttccaaatacggtcaaattgtgaggtattgggcttaggactttaatataaaaatttagaggtgacagaatttaacccataacaacagcatcttaatttttacacattttacttttcatttctttttaaactgttattaataatttattcatttgaataaggattaaaataaggctaggatattgaaattggttgaaattgctacagtctcttgtatctctctctctctcttttttttcttataagggacaggtttcattcaccttgtcgaccaggctggagtgcaatactgtgagcaagggtcactgctgcctcgaattcctgggcttaagggatgctcctgcctcatcctccagagtagatgggactacaggtgttggccaccatgactggctaatatttttacttttttgaagagatgaagtcttgccatctggcccaggctggtcccgaactcctgggctcacacaattctttcacctcggccccccaaagtgctggattgcaagtgtgaaccactgcacctggcgtcttgtttcctcttaatctacagtttcccccttttgccttctttttttttctttcaatttatctattgcagaaattggctttatctgtagttttctaaagcttggattttgctgaatgcttctttataatgacacttaacatttttctttgtcatttgtatttctcataacttattatttaggcctagagtctgtatgtgattcaggtttgatatttgggcaaaagtatttaataagtgggattacgtactttcaccaagagacacataatatggttgtctctttctgtgattctagcagccatggataattatttcatagattattattttcttggggatggcaaaatggtgatattctaattttactattccttcatttactagctggaatgtctttttaaattatttatttatttatttattatttgagacagagtcttgcactgtcacccaggctggagtgcagtggtgtgatcatagctcactgcaacctgcaactcccaggctcaagtgatcctcccacctcagcttccccaatagctaggactacaggcacacatcacctggctaatttttaaattttttgtagagatgagggtcttgcttttttgcccaggctggtctctaactactgggctcagcctcctaagctcctcctgcttcagcctcccaaagtgttgggattacagacataagccactgtgcctggcctggaatatttctatatagaaagttctcttcattatctacttcattgctttcaggtatatgtaagaaagacaggataaaccactagattttgaaatgtatttataaattttcaaaataatgagttgagtcctagaatctttcttttattattattattattatactttaagttttagggtacatgtgcacaatgtgcaggttagttacataggtatacatgtgccatgctggtgtgctgcacccattaacttgtcatttagcattagatatatatcctaatgctatccctcccccctccccccaccccacaacagtccccagagtgtgatgttccccttcctgtgtccatgtgttctcattgttcaattcccatctatgagtgagaacatggcggtgtttggttttttgtccttgtgatagtttactgagaataatgatttccaatttcatccatgtccctacaaaggacatgaactcatcatttttatgactgcatagtattccatggtgtatatatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggttgaactagtttacagtcccaccaacagtgtaaaagtgttcctatttctccacatcctctccagcacctgttttttcctgactttttttttctatttctagactctttattaagattcattttcctatgaaaaagtccattctttagtcagttctacactgtcttgattaaggtagctttataggaagtttttaaatcaggtaatgtaacccctccaaattcatcctcccttttcgaaattgtttggtcattctgaatcctttactttttaatataaatttaaaaattatcttgccaaataatcttgtttgaattttaattgggattgtgtggaatttatagatcaatttggggaagactgtcatctaaaaatattgaatcttcaattcattaacatgaatttattcccccatttatttttatttatttatttatttttctttattattattatactttaagttttagggtacatgtgcacaatgtgcaggttagttacatatgtattcatgtgccatgctggtgcgctgcaccgactaactcatcatctaccattagtttcctgactgtttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccattttttgatggggttgtttgtttttttcttgtaaatttgtttgagttcattgtagattctggatattagccctttgtcagatgagtaggtcgcgaaaattttctcccattttgtaggttgcctgttcactctgatgatagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatacaagggacgtgaaggacctcttcaaggagaactacaaaccactgctcaatgaaataaaagaggatacaaacaaatggaagaacattccatgcttatggataggaagaatcaatatcgtgaaaatggccatactgcccaaggtaatttatagattcaatgtcatccccatcaagctgccaatgactttcttcacagaattggaaaaaactactttaaagttcatatggaaccaaaaaggagcccgcattgccaagtcaatcctaagccaaaagaacaaagctggaggcatcatgcaacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctattgaataaatggtgctgggaaaactggctagccatatgtagaaagctgaaactggatcccttccttacaccttatacaaaaattaattcaagatggattaaagagtcgtagcatctttcaaaggtgactaatgattttaacattattactataaacctatagatttaaacataattgctatgttttaacccattatagttattattcctgttgatgatcaagctctatctttggccagtgggagcctctgcaaattgattagtgaatctttttgacatggaactattagtctttgacaaaatctttgatttctggtatgacaatatattccagttttatcttatatacttccagtcctatacataatattaactttttttcaaagaattactggttttatttttagtgggaaatggcatttaaaataaggaagttggcgaggcgcagtggctcacgcctgtaatcccagcactttgggaggccgaggcgcgcagatcacaaggtcaggagttcgagaccagcctggccaatatggtgaaaccccatctctactaaaaacaaacaaaattagccagacgtggtggcacacacctgtagtcccagctactcaggaggctgaagcagaaaaaaataaataaaataaggaagtctgcctatatgggttatctacctcttttttagggctcaacctacccgtttcacacaaacccaactgaattcggactctatatgtgctaggcaagtttgagctttttcaggtgtacacacagggtttactgaactctggcatataattatttatttattcattttatcaagttttgtcctatcattgaaactcattcttgaataaagttattatatttagttcagttacagcagacaccccattttgaaaacattatgtcaacattggcttgtgtaccttgtcacatcagtaatgtacagttctcatttaccagaaatttttatatgaacaacatattgaagttattaagttaatgaattctgccaaggtattggtatatatttgttcattataagcatttaaaaacaaaggaaccttttaaagttgaagataatttaatgggccattgcatgcaaagaggtgttgcattagtaaccaaccttaaactactgctgaaacaactttatgcttgagttagatatgttgatgggagccaataattgtgaaatttgtgtatccagactctcttctgctctgttcttaatggatctagtgttaatgttagaatctagtgcatttcacaactgttgctattatagatggaatatcaggaggggtagtgaggtattgagatagatgaaaacattttctaaaagtggctcacgcctgtaatcccagcactttgggaggctgaggtgggtggatcacctgaggtcaggagttcaagaccagcctgaccaacatggtgaaaccatgtctctactaaaaatacaaaaattagctgggggtggtgtcaggcacctgtaatcccagctaccagggaggctgaggcaggagaattgcttgaacccaggaggcagaggttgagttttctccacagctttggatcctgatgacttttttttttttaattgttactttcaacttccttgctttgactgaagccatacttacatattactgataacatatgccatgggccgcgcatggtggctcacgcctgtaatcccagcactttgggaggccgaggcgggtggatcacctgaggtcagcagttcagaccagcctggccaacatggcgaaaccccgtctctactaaaaatacaaaaattagctgggcttggtggtgggctcctgtaatcccagctactcgggaggctgagggaggagaatcgcttgaacctgggaggcagaggttgcctgtgcactcgggccactgccgtccagcctgggtgacagcgcaagacttcatctaaaaacaaacaaagaaaaacataatccatgtatgtgatgtaaagagcgccaacatgtttatatcctcctatttcaatctacttttacttcatctacatttttagcaataatgtgaacatgaaatcttgaataattagctatctgtaatatatttactcatccactcaaaatattgagcccccccaataaatatcatacactatattctaggtacaggtgataaacaattcagagagtattaatttcaaaacatggtaagtgcatagtgagagagctgatctggtctggtggttgagggaatcaagagatatttgagttgaggtctgcagtattatagaaaattaactaatcaaaagagaggcagtcattccaaggaaggggatgtgagtcagaagaaactgcatgtggcaagctctgaggtgggacaaagcaaggacatattgaaggaattgtgactggagcatagggatggaggaaaacattgtagctagctgagaaataagcatggaaaaatgttgtagagctgtataggccatgttaggacttttgtctttatcttaaggataagccattgatgtgtttataaagacacatgatgtgatcagattttcagttaaatttaaaaaatacttggaatgcattttggagaatggtttaggggagaggcaagagtggattctgtgggccagtagttcagaggataggttatggtagcttggactaaagtgcctgagccaagatggagagaagtagattgctttaagacatatttaaagaataacatcagcacttagcaatgaactggagatggaagatgagggaagggaaggtgttaggcaggtttttacaatgagagaggttggtgatcatggtcaccaaggtagggaatgctggatgaggatgcagtttaaggtgaagattatgagttcaggttcagcaaaactgaacttgagacatggtgaactatcaaggtggagatatccagtgaaagttagagagaggggtctagagctcagggaggagtgtgtatccctaatttagactaatttgcattaacagctgtagtaatgcaattttctctatactgaaatgcagacatttgagtatagaaaattagcagacatttgaatatagaagaaagatttactttccttcagaaaaagaatagtagagtataaagaataatatttaatcctaggaattaataccaaaccctttaaaaaaaacttttaagttcaggggtacatgtgcaggtttgttacataggttaaacttctgtcatgagggtttgttgtacagattgtttcatcacccaggtattaagtctagtacttgttagttagttatttttccttattttctccctccacccatcttccaccttctgataggccccggtgtgtgttgttcccctctgtgtgttcatgtgttctcatcatttatcttccacttataagtgagaacatgtggtatttggttttctgttcctgcattagtttgctaagcataatggcttccagctccatccatgtccctgcaaaaggacatgctattgttctttttttatggctgcatagtattccatggtgtatatgtaccacattttctttatccagtctatcactgatgggcatttatgttgattcaattttttttggctattgtgaatactattgcaataaacatacacatgcaagtgtcttcataatagaatgatttatattcctttgggtgtatacccagtaatgggattgctgggttgaatggtatttctgtctttaggtctttgaggaatcatcgcacagtcccccacaatggttgaaccaatttacactcccaccagcagagtctaagtgttcctttttctccactacctcaacagcatctgttattttttttgactttttaataatagccattctgacttgtgtgagatagtatctcattgtggttttgatttgcatttttctaatgatcagtgatgttgagcttttcttcatatgattgttagccacatgtatgtcttcttttgaacagtgtctgttcatgtcctttgcccattttttaataggggtgttttattcttgtaaatttgtttaaggtctttatagatgctggatattagacctttgtcagatgcatagtttaaagaaatgttctcccattctgtaggttgtctgtttactctgttgatagtttcttttaccgtgcagaagctttttagtttaattagattgcatttgtcaattttttcttttgatgcaattgctctgtgtcttcctcatgaaatctttgcctgtacctatgttctgaatggtactgcctagactgtcttccagggttttgatagttttgggttttacatttaagtctttactctatcttgagttaagttttgtatatggtgtaaggaaggggtccagatttaatcttctgcatatggctagccagttatcccagcaccatttattgaatagggaatctgttctccattgcttgtttttgtcaggtttgttgaagatcagatagttggaggtgtgtagtctcatttctgggttctctgttctgttccattagtctgtgtctgcttttttttatgttcttaacttttatttatttatttattcatgtattcatttatttttaccagtgccatgttgttttggttgctgtagccctgtagtatagtttgaagtcaggtaatgtgatgcctccagctttgttctttctgcttaggattggtttggaaaattagggcacttttttggttccatatgacttttaaaatagttttttctagttctatgaagagattcaatggtagtttcataggtatagcactgaatctataaattgctttggccagtatggccattttcacaatactgattcttcctatacatgagcatagaatgcttttccatttgtttatgttatctctgatttccttgagcagtagtttgtggttctccttgtagagatttttttttgtatcctgagactttgctgaagttgtttatcagcttaagaagcttttgggctgagacaatggggtcttctagatataagatcatgtcacctgcaaagaaagatagtttgacttcctctcttcttatttggatgcctttatttctttctcttccctgattgcccttgccagaatattcaatactatgttgaatagaagtgttgaatagaaactaatgctgcaagcattagtttcaaagaacttcttgatttctgccttaatttgattgtttacccaaaagtcattcaggagcaggcgtttcactttccgtgtaattgtatggttttgagtgaatttcttagtattcatctctaatttaattgtgctgtggtctgggagacagtttgttatgatttcagttcttttgcatttgctgaggagtgttttaattccaattatgtgatcaattttagagtatgtgccatgtggtaatgagaagaatgtagattctgttgtttttcactggagagttttgtatatatctatcaggttcatttgatccagtgttgagttcaggtcctgaatatcttggttaattttctgtctcggtgatctgtctaatattctcactggggtgttaaagtctcccactattattgtgtgggagtcagtctctttgaaggtctgtaagaacatgattatgaatctgggtgttcctgtgttgggtgtatatatatttaggatagttagattttctcgttgaattgaaccctttaccattatgtaatgcgtttctttgtcttttttgttcttgttggtttaaagtctgttttgtcagaaactaggattggaaccctgcttttttctgatttgcatttccttgatatatttttctccatccttttattttgagcctatctcattgcatgtaagatggatctcttgaagacagcataccgatgggtcttggctctttacttggcttgccgctctgtcttctaattggtgcatttagcctatttacatttaaggttatgatcctgtcatcataatgctagctggttgctttgcagacttgtttttgtggttgctttatagtgttactaatttgtgtacttcagtgtgtttttatagtgactggtaatggtctttcctttccacaattagtgcttccttcaggagctcttgtaaggcaggtctggtggtaactaattccttcagcatttgcttgtctgcaaaggatcttatttttccttctcttatgaaacttagtttgaccagatataaaattctgggttggagtttcttttctttaaaaacattgaatattggcctccaatcacttctggcttgtagggtttcagctgagaggtctgttgttagtctgatggggttccctttgtaacctgggctttctctctggctgcctttaacatttgttctttcattttgaccttagagaatatgatgattatgtgtcttggggatgaacttattatggggtatcttactggggttctctgcatttcctgaacttgaatgttggcctctctggctaggatggggaagttctcatggatgatattttaaaatatgctttccaagttggttccactatcttccatttttttcaggtaaaccaatgaattgtagatgtggtctctatataatcctatatttctaggaggttttgtttattcatttttattcttttttctctattcttgtctgcttgtctaattttggaaaggtagtcttcaagcttggaaattctctccttcacttagtctattctgttattaatacttgtgattgcattatgaaattttgggggttgggagtggtggctcacacctgtaattccagcactttgggaggctgaggtgggtggatcatttgaggtcaggagtttgagaccagcctggataatgtggtgaaaccccacctctactaaaaataccaaaaaaaaaaatcatagctgggcatgggggaacatgcttataatctcagctactggggagactgaggcaggagaattgcttgaacctgggagatgaaggttgcagtgagctgagatcgtgccactgcactccagcctgggtgagttgagagtccgtatcaaaagcaaacctacacatttttgtggcctgtttttagctctatcaagtcagttacattcttctgtattctagcttttttatctgtaagctcctgcaatgctttattagaatttttagttcctttgcattttgttacaacatactcctataactctgcgaacttcattcctatccatattctgaattctgcttctatcatttcagccatctcagcctcagcctggtactgaacgcttgccagagaggtgatgtggtcctttggaggaaagaaggtactcttgattattgagttttcagtgttcttgtgctgattatttcttatctttgtgggctcatctaccttcaatctttgaggttgctgacatttggattattttttcttttatcctatttgatgaccttgagggtttgattgtgttataaggtcaattcaaccaactagctttgtatctggaagactttagggggccatcgttcacctcccaactcctggactgcatgttctaactctggatgacttgtattgggccccaactttgttctctggttcctcgaggtttggagtctactttgttggaggaccaaggtgtggcagctccagctgggtgctagcggattcaggggtgcctgcctccctgcaggcattcaccatgctagtgaaggcaaggcatttttgtggggaacaggaggctcctgctatagactgtctgtgcttttgcactggtgatggtgttggtttggtgagaggcactgaccagtgcagatctgagtgccttcttggtcacctgcaagcaggagggattgctcagggtgtgggaggatcctctgttctccatgcagcattaccacaagagtgaggcactggcagctgcagggcttgctggctgtgtgctgctaaggttctgtctgcaatggtggttgacagaggtcaaggggcatacttccctcctgtatgctagtggggcaactaaagcaaattccacctgtgcagacatgtgcctgcaaagtgatgtggggagttgccatgggctcaggggaagttgcagtatgggtagcgaacacccggctggtgtgcgcagtaagggctgtcttgctggagttctccactggtcaggcatggcccactggtgcagaagctattctgtgggccaccacagcacccaagatggccctagaagaggccagcagaccaaggagtgctcaggttgcaccagccctgactgatgtacaagaccactctgcagatatcaagtctgaaaattcccctagggccaaagtctattatgggagcaagttgagcctagagggatcgccatccctgtccatgcactgctgtagacactcctgcactaaaccctctgggctccacatcagctggcttgctgctctaccactttgcttgtctcttgggggctccaccccagagagatgtgggtcagcaatcattcagttcaatcagcccaggatggagagtctgtgctatgggcccaagccaggggctctctgtctggtgacgagcagctggggggtggggtgggacctgtgggagatggactggcctcctctccttgagtcaactgctgcttattggaggtgtggatgagacacttagggtctttgctcctttattagtcagagggtagcaaggacagttccattgcagaggtagtggcagagaggctttcagttgtccgtggcggctctgtccagggagttgctgagttgctattggcttgatatctctggtggggtgtggctagaggtccaggcctggaggacctgctcgttgaagagatgtgggaatgggcacccacataacagtctgttcacttttccatagggctgctgtagtatgctgggggccagctccagtccctggtcactttagattttccagtacctggaggtgtcaccagtgaaagctgcgaaacagcaaagatggtggccttcctttctctctgggagctccatccctgggaaatacaggcctgttgctggcccgaacacactggtaggacatggctgaagacgctagttgggagacctcacccagccaggaggaataggatcagggacctgctttcaaaagtagtcttgccccattttcatagaggagttgtgccatactgggggtatgctttagcccctgattgcctcagacactctgaagcccaaaggctggaatggctaagttgttctaacagcaaatatggtgggctgctcctctccctgggacaaaggtcccatggaagtctgaaacctctctcagtcagagaacaccagttggggtagccggggaccccagatgggagactctacccagtgatgaggaacgggattggggacctgctaaaaaaaaaaaaaaagcagtgtggccacatttttgtcgggcagctgttctgtgctggggttccccttccacccctgcttaagctccccaaagcctgaaggctggaatgggtaagttgcccaaacagcaaagatggcagcctgcccctccctctgggagctctgtcccagggagttttcagatctctgtcagctggagaacactggcaggtgtggctggaggccccagttgggaggtcccgcctgtaaggatgaatgggatcggggaccaacttaaagcagcagtctggccacattttaatagagcaactgtgctgtgctgggggatctctttggcccctggttagtttggactctccaaagcccaaaggccataatggctaagttgcccaaacagcagagatgggggcctgcccctcctcctgggagctttgtaccagggaggcacaatgttgctactggtggctagctggaattccaagccagtgggtcttatcctgtgaggcgctgtggaagtggggcctgtagaccttctctgctgatctcgctggattcagcctcttttctggggtatgtatgggagtctaacctcctggggtatgtttgggggtctaacctccagctttgccaaagtcgcagctacttttgcccagacacccagaaagctggagtagctaaagctcttgggtctccatgcatgcctgagtggctgctctgctgagactccacgtggctgtgtgtgaagggcctaatggagtgagttcacaaggggatctcctgatctgaggtttgcaaagatctgtgagagcagtgtggattcccagagttgcgcattcacttaccacttccctgggaaggggagtttcccttgactccacgtctttcccaagtgggctgtcttcctgccttgatttgctctggtctccgtgggtcgagttgtttccttgattacttccaatgagagtaccttaatgtttcagttgaaggtgctatatttagtcacccctttctttccgccctgtgagagtcacacacattaactgcttctagttggccatcttggccactcctgccctaaacctttctagcaaaaaaaaaaaaaaaattaataacatgttgatctaccgcttctctctctttaaatttatttaatcattatgaatttttttacatttatttacattgttaagctgttttattttaaaaattctaggtccagctcttcctggattgcttttatataaggaacatatctcatgaaataaataaaattcacattcaaatgcagaagaatctattggaaaaaactcagaggacaggataaaagcactcagaaaaaatgccaggagaaggcgtttatcacataatatcgctgataagagtctctcgaaaatttttctctctattcattcttaccaaatatagaaagtgaacaaaacaatattagtattagaaaaaacatccaaaaataatgacctttctgaatgaagactgcttttttcatggttactctttttggggtacagttctatgttgatttatccaatttatcaaatagccattcagcaaatatttattgagtgtctgttatgtcacaggcactcttttcggtcctcaaaatacatccgtgacaaagagtaaaagattcctgttcatggctcttacattccaggagggatagcaatttcttttgtaaagttaatcacacaacagaaatgtgaaataatattgatgctgtaaggaaaggaaaaataaatgaaataaattgaaaaagaaatgtgaaggaataattaaaagaggctatattttattgaataaaaataaaagaggctatgttttattgaatatgctccatgttttatactatatcataaaacatacaagatctggcttttaagaaatcaatatcttcatcaatatcttcattcagactcatctagattagattactctgaatctaatcacatagagacttgtctgacaaatccagattttttggacgttctgcaggactatttgtcaggatatttcacaggattccaagaaataatattggtgtccatgctataatgattcctcagctcctcccatctgataaaatattgatttcttatacatataaaacatataaaaatatttaaaatattttttgttatatgagtgaatcaataataaaaccactatctcaataatcatcaactgattgcaaactgattgttcatctcagaaaaaccttggcagagttaaaataaaagtttcaaaatacagaacttagtaccaaaattaaggcagtgttaggtttctaattttgctattcacatgttaaatgaattttcaaaattcagtagctaatactagctagggttttaaacaagacatagttaaaatgaaactttaaaaaaagaatcataaacttcagtatcatcatgatggcagttttaggattttaatgttgacaccctagtctcaaatttgtacttaatgtggttatatagctaggcagtgctggagtgaaagtttcaaaacaaattaaaatcaaaagttaagaaaaaaatatgaaggcaattttaaggtgtttaatttggcactgtagtttcaaaatagtacctgaaacttaacagcaaagtatcagattcatttataaaacaatgtgactgatctttatgtatggtttgtgaaacatttatgcagtgtcacttcagaaaactctgccattatagatttgaattgattaaggatatccactcctttccttggcatgatacaaataaattactaaagtataattgtaacaatgataaatataagtgacaataccaccatattactatgaaacacagattgattatggtataatacaatttagcatctccatatttttgaaaatgaacttgtttctctaactggcttaatttgggacaatttggacatcaaaaagaatgatgatgcaatttaaaccatacaaaaattaaaaaaaaaaatccaagggacggtggtgaaagtcttctttctagaagaatagcagctaatatacacagaacgaatcttagaattagaaaatcactatattttgatccccttccccaaagggtgacaaaaccattggtagacagtggttgagaaacagaatagtctcaggatatcactccgtagatttattcattaattaaaaagagaaaatgtgctttgagagagagaaagctattaccgtctttatcaaataggagagcctgatcatgtgtggtctgaagtttatctaatgggattcctgatggaatgtttagtctgaatctaatcacatagagacttgtctgacaaatccagattttttggatgttttgcaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgtaagtgctgtttgggaaaccatcatctttcaggtctgtgtgataaaagaagagccttggggaaatgttctcttccaaatttaatctttacattattagaaaatattttgatgacctgttttcaaatattttcttataactttccattttcatgtgtttattctgacagtttattttatcttgtatttataatcactaagatgttagtattgtaatattaatattacatgatttaaattaggaaaaatgtgttttctattacaaaatggatagtggataatttaagtatagaaagtaatattttctatatgggactatttcactctctgtaatatcctgaattctaattcccactgtagtgagctataactttactaatcagttttcttacaatcgattttaagtctattttgttagatctaaagacataaagccaaaagttcttcttgaagagaagcacatttcagttacgtttataacttgaaatatctggttttactcaaaactcacatgtcatactgaaaaacagaagggagatgttgtcttttcttgaggagagacttctctgcagttaaacagctcaccacatgtttagagtacatagacaatacacttcctcttttgtaatgtagatttcagctttttgcttgtagaattatcattggcgtggaggttatacaggggaagtagtgaaaaatgtagccaataccaggaaccttaggaagtgtctgaacttcatcttttctgtgttcctttgcccttagggggtcagtgtaagagtttgggctaggaagagattgcttcttttactctatttagtttgtacttcctatctgggtatttgacaataaatgactcattctctttgtttgccctggtgttgaaaaattttcccatatgccagagaaaaaatgttacagtgacacaatgtaaaattgtaagaggtggaaaaagatgaggtatggacatagtgaatggaagttcagccctttaaaactactggcagagtagattttactcaggcttcaattaagtagacctgaatgtaaattcaggtctagctctgcaacttactaggtaagtgactttagtcctctttaagatttagtttcctcattacaggatataataatactatttttcttatgaggtaagtattaattgaaatagtatatgtacattctagcatacagtgatcccctaataaatggaacttatcattaatacattgctaggaaaagaaaaacacatcagggaacaaaagatataactgtcttattgataacaggggatggattcttgtggacaaaaaaatttagaattgaattttcaaggggtcatttctttcaccaggtgtagttaggtttgctcttatggtaacaatgaatatgtttgtttagcttcttaaaccggcatcatggaacgttaattaataaacagaattcaatgtatttgtggggcattttattttttatgcaatcatttgtatatgtcaccttcacaatgcatgccacattctcagaccacctattatgttattttcttaacatttttcttcaaattcactcacccttttaaaaactttactgaagtctcacttaagcacataatttgtaaaatcatgggtttgttgtgcaagttttgtttttctaatacactctaaaacaaataccttaaaagagttacacctacagtccatataccacccataatcatctcaagtacctccagtgcttgttactgcactttggaaaacactaacatacattattctcattagtttttataatagttatatgaggtgaatagagaaggcataactatacccattttaaagatgagaaaagcaggttcatggataaaatctcatagtaaattgctagaattggtcctgatactcatgctttctttagatcaacccagtgctcttactgtaattgataccaaattctttaaggaaacttagagctaaaagtaaaattttttgtatttagacctgattattttgtggtaatttgaatataggtcaatatgaaaaaaaataaaagatgaaacaaagaaactgagagcagatcaccaagttgcggtaggttagcctaagatagcttttggttttctcagccttctactattcacagctttgtgtaatcccctccacttgagtatcttgctcataccaatagaatatggtagtagagtagaggtcacctctctgataagtttacagaagattgcgacctccgtcttgccagagtacttcctctcttgctggttttgatgaagcaggctgccacagaagagaggctcacatggcagggacctgagggcagcctctggccaacagcaagcagtaaacagatgccctcagttcaatatccctcaaagaaatgaatcttaccaacagccagttgtgttagctgggaagcaaatctttccctaagggagatttcagatgaggcccccagccttggtagacaccttgattgcagtcttgtgagagattgtgaagcagagctattctcagaattcatgggtgttttaagctatgaggttttttttggggggagaatggtcatttgtgattcagctatacataagtctacaaaagtcattccagaagtgattcagtggaggtagaatcatgtggttgtgagccccaggcacttggagttctgatagaattgtgacttctaacactggacaccttttctttttctcttattctcccatttttctcctttccccttttcctcccttccttcccttcattccttctactttttccgtactttaaattaatagagcagttggaaacacaaaagcaatgtctgtatctacaaaatgtcattatttatactttgtatccacagtgtgctgcctagggcttcatgcctgaggtgcatctgtagaaggtgctcaacaaaggcttggctgttggtattattgaatcactgtggagtttattcattgttgtccatgccattttgagttttcatttttttatttatgggagtgtctttattcttttaaagagctttgtttgtacactcattttctctctctctcttttcttccacaggcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcaggtgagcaagcattactgcttgagttccgcctcctgtcagatcagcagtggcattagattctcataggagcacaaaccctattgtgaactgcacacgcaagggatctaggttgtgcgccctttatgagaatctaactaatggctgatgatctgacgtggaacagtttcaacccagagcaccccccacccacctgcagaagaattgacttttacgaaaccagtccctggtgccaaaaaggttggggaccaccgctgcactacactacctaaaagattttcactttcacagtgttgcttgcttctgttttacatgcacaagtagctaaagctagccttctggtaaatggaggggcagagcagatggtgggggaggagtacatacggacgaatttgaatcacaatttcctcactatatgccagcaaaatttaataatagcacctaaacatacacatgcatatgtaaatgagtcacactataaaaacttttaacaagtactggcaagtcagatggcagacttaccctgaaacctgccactccaataaaaacctcataattaaaaacaaggctgtctataaagcataacatataataacaattatttgcaactggtacaaggctagattagaaagttgaaagttatctttctcaggtaaaaatgcttttcctatacagtatgcagccagcagattatcatccatagtttgagtagtgagatgccacttgctccaacaattaacacctgctgatgttggtccaagaagagactgaggtgatgcagtttcacctgttttgtaagaataacgctggtgtttgccatctattgacagagtgcctactacgtgccagatgctttgttggcactgaatgtgctatctcattccagtttctttatactcaatgaaaaaccaactacatttatattgcattgaggcttaaagtggtttactgacttgcttaagattatacaagtagtaggtggctacagcagggtttgaacccaagtatgcttgattccccaaaccatgctttttaaaaaatcaaaggtgtaacttcgataaaagacatgaagttaatgaatatatgaaagatggtgaatagatacagatacaatgtggccttaggccagatcatgttgaacatgtggtgggatagataagagaaggttcttctttgttgttacctggttctcaattggttattactttatgtgctttccatattaaaattctattattctggtctataaattcacccacccagacttgcctaaactaattaaaccctgaagtttggcatgtctcttttttggggtgcctctatgataggtggtagaaatgaaaatggaattaaaagttttgtgaagctatagcactactttttcattgtgttcccccctgactttctgccttaggtgtttactttggtgagatatcctgggagaaattgaggtgaaaagaagcccgagttaggattagggaagagatgaagtagtcaataaaattcaaattcttgtattctgaaacgcaactattctttctccaacttggttttggacagaatgtcttagtgtagctgttaacaaagaaattgatgacaattaactcccatttctcagaatttcatcattctttgaaagtgtttatcatactcaatcttctaaaaatccttaaggcatactacagtgtagaggttggcaaactttttctatagaggtcctgatagtagcttgtttcgcttttgagggccatcgagtttctgtcacaactactcatctctgctgttgtaataaagactcacccatagacaatacatgaatgaaggagtatctatgttccaataagacttttaaaaataaaattaggcagcaagactgatttgacataagggtcataatttgctaacctgtggtatagtgaaaggagttcaactagagtttgattatggctgtgccattctagttgggtagttttaggaaagttatttaatttagatttgatgtagttttctcatatgtaaaatggggataataaaacctgcttcacaagactactatgaggagtaagctatgtagctaaatatagcaaaatatctggcatctaatagatgcctaataaatggtgactataatgattcttatcattactgtattattttaaacatttatcttttttttttaggttgttgtctaactaaggtatttagagaaaataagtgctgctgagggcagctggaactgttttgctggttcatcactgaaattctagttcttgttggtgcttatttcataattatgaaactaattcttttgaaaagaacttgaagtagagcaacaagaactaagatagaactaataccattctctctcagttcttattgctttacttcaagttcttttgaaaagaattacatagatatgggtgcatgtgtttgtttattttccttgttgggtaatcgtgaatatgttgattggcgtcaaacatgggtctcacctatacccatggcagtaagcttctattgatttgaattcagactagccctggtggccctgtgagtgggaaagtctaggtgtgcctagcttggtctgtggttccacgaggggttggatgcatctgttctacttgtggaatgttggcaccaatatattggctgcttctccgagtatttgcctttgtcttctttgtgaaaggtcactggctggtttgagctattgggctgtttatgccacatcctgtgcatgccacactggctttctttctgtggtgtttccagagataagtttgcctgatagaagtcagactctgtggctttttatcattatagatttttctagaaggagaagaggccatgatcacatctgaggatcctgagtcattgtagacatgtactgaattaaagagaattttttgactaaaggagaattgcatcaatcacggtgaaggagatgccacaggacagggcctgaggtgttggcttagccacagatgtaagggctacagttaacagacaactttcagtttccactattggaagggatgatcagtccttccctcctctattttcttgagccccgtttttcacctttctttttctctctcctttcttatcatgaagaataaagacaaatgagaacagatctaccttaggctgatacagggcagggaatccatttaataataaaacgtgggtcaaaattcacttttctccttttgaattgaaattatattgtgcatgggctaattagattgaatgctgtaaacatgaagataatgcttgcaaagtagctacagagaaagagaaaaagcctaaaacaaccagtagtgcttaggaccaatagtataagtctttacacactacatttgaataatactgtaagacacaattctttgataggttaaatagcaaatctaggccccccaaaattatttaaaaaattgtcattttaattctagaggtataacaacagtgtgtaagttgcatcaaataacaaagttagtctacagcctaaattgtttcgtcctgcttttttcacttctatgcatatttttatacttccatgctagagctacctcattcttttaaaattgtgagatattctataatttatttgtattcccctattaatatatttttagcttattagtttacttaaaaagatttatgtttgccttctaatgtcaaagttaggagtcatctgtccatttaacaggtggtgttttcttgtgtaactcctctgccttcatgcaaacctttgagaacaatctcttgaaacaaggctaaaatgcctttggagaggtattatagatgatcatatctactttgtgcctctttccattacttagctgcattagaggcccagctgtgtaggtgtaactcaaaatccaccaaaactaatactgtggttagattctggtcaaacaagttgccattaatccagatgtagaatgggattgaaaggtggctcttccacaccctgacatcaatgtaccagtttggctctgtgcattctttctccccttctccctttaccaccctcatataattgtttgtgtacatgtctggtttcgtcactacgctgatggcaaggatcatgcatgccttattcatatttgtgttattcaaggattctactctgggttctattatggggcctggcctaaagtggttgttcaagaaatgtgtgttagagaaatcatacataaactagcaattctcatttggattcctgtatctgaacaactaactttcagcttcttcagtgggataaagaagaaaaatggggtttaaagtacatactattcagtattaatgtagaatttaacagctgccatccaagtgcagaatcctctgtagtttcccagtgttaacctcacttctatctctagccatgtctcagtgctgggtgactctctcctggcatgttctggcaagactctacctggtttgcgtaatctacatcggcttctagtttccacaagaattgtttatatgcatttaattttagctcttgggctataacatgtcattgttctttttacttatctcctcttacttctggaaacagggcaggcatcttcaatacttgctgttcctgtttggtgtgctcttagattaattttaactttcctcttcagctttcatgacacttcaagacattttccagtcatatttcctgtataagaaaatacagactatgtcaccacaaagggtagtggagattggggggcataatttaattcattcagggaactcatattttggtgtgaatggaaattaaagcaaggtatttggattaatttacctcatttggttctatattccatttagaggataacacattaagcttttattcaattttatctgttatggtcacagtgaatctggaaaaaaatatatatggggcttagttttcatatttaggggaaaatgaatatcctagagaataataataaaagttagggaaaataatgttttcctaagagtaggcaatgaaaatctgaaggtactcaaagcagtcttgcacaagtgctttgaaaagcctcttgcacaattttatttctttatagtacttacacaatcatatttcataatgacttgctataaacaatgttcttgacaagaagcttaaagatacaaaactgaaggaagcacttttgggagaaaatacttttatatttgcttacttctacactacaacagacataaaattatggatttttttttcagtgcaattttcatatgtcagttctaggagacaggaaatgtgaaacactgtaggaggtatgagtttgccacctagaggagagaggtgaaattcaacttttctccaatttctttagtataattcattaatttatttaattatttactcgtttaattattcaaaaataattatctaccaagcttaactattttgccagcgcagatttgataaatctgttcaagatttatgagctcaaagaaaccacaaagtgcatcttactttaattgctcagctgcctcttttaaaaatcttttacttttaagagagtatagcacaaatatctgaacaactctaaatatccatacttgggatggatattactttgagctcttgcactataataaaactttattcttttgtactaattcagtccttttactttttcttttttaatgtttaagaaacaagttggatatggacaagatgtaatttcttctgtcaaggaacccacaggataataggttaatgatagagaccaacaatgctgatgcatttttaatgacggagataatgtctagaaaaaaatccattatttggtaaagacaaagtatgcatatgtattcctttgtttcaattatttttaaagttaaaaaacaactgcttatctccttttgtactacaagcaatatctggtatagtgtatgcatagtaagtattctagaaatagtaatttcattgttgacttgattatattggagtggaacttactctggaagagatcctaactttcatttatctgagaaaatttccagttaggacatggaaattttttccttgtcaatatttattcttaatgtgtttagaattttagaaaatgggtttagggatttagaaatttctttactaaataactctagggaacagtaccttaaaaatattcaaaatgacaaaaacttaaaatgacatctaattttttaaggccaagaatcattaaaaagggatccaaatctttagactttgttgctcggtggaactagaatcattaatatctcagtcaggggaagccatgtcaacttactggtttaatttcctgtgagcttcccatgttctctccctgcaaggaccacctcaaatccctcagtagtcctgtctttatgaaaccagtataatttttcttttcgctcttgtccttcaccttcctgtggcaacaagagtcaattctccatatataaatactcggcccctgttttagctgtgtcttaattgcgcaacatctgtttactctgtgttttaacatctgtgtggatagcattgttgttgtaatattttgactgtaagcttctaggaggtagaggccagcattattttctccatttttggaatgagaaaatacagattaccacaatcaaagtagaatggcagcttatagtagttatttggataatttatatagtctcttaaaaaaacagattatagtaagaagtggctgagcaattagctatggcacactgcacggtttttctgacctctcagctcctaaataaactttgccaaatcttcaggccctcaaaattttttcattccatttgttatgggctgaattgtgttcccccgaaatgactatgctgaagtcctaactcctagtgcttcagaatgtgaccttatttggaaacagggtcattgcaaatataattagttaagatgcgatcttactgacataggagaagctcctaatcatggtgtccttataaaaaggagaattttggccatagagacatgcactgggagaatgctctctgaagactggagttatgctgctaaaagtcacaaaattaacagaagctacggaagagaccttgaataaattcttccctgtagccttgagggagaggatggcccagccaactgctaatctcagacgtctagcttccagagctgtgagacaatttctctttttaggccactcagtttgtggcactttgtacagcagtcctagccgactaacacaccactctaactgttgatcaaggcaagagcctgtgatcatgtattatcttgcttattccttatcagcattctatggtgtagatattagtgccatctatatacaaattaggaaatggagcctcatagaaattaaatgacaagttcaaggtgtcatggctatttcattatagtgccagtgtttgaacacaaatcaatttgactccaaaacatcattactctactcaattctagttcaatccagatgttcacaaacaaccagactatagtggagatgtgggtggtgggttgagaaggagatcataaccaacatcagactgtcagtgaagcagactgggagaagttttatgaagccaagcagctgtgcaaggtacagtagagatggtcagattgttcatgtgtatggattccatcttctgaggaatgaactccttgatattcctgagttagtccagtttaggcaggagtaaacagaaggtaaacagaagattggagactgtgtgtgtgcacgaatgcctcctttgtagctggatgtctaacatcatgatagccacactcacatgaatacagagatacacaatttacaaattaatgtaacataaaactcccatgcagtctgatttcatcttactgacatttctgtcagtcagtgttagcatcttaattatataaatgtggaaactgaaatactcaagaggttccctgacttcccaggccacacagtaagctttggtgccagaatgtatctctaggctttctcatctcaacccagcattcattatactattgctcactgcgtgtagaatcagatttgatttctctgacttttcttagtcacttctgtggttttgtaccactccctctctcactaaataactgcctgcaaaagtaaaaatttccatgaaaacagaaaacaaatgtaccagaaatgttgatggtgtaagagataaaactgggataaagagaaaatgtgttggaaagtggtgtcctttaatgcaacagaaaagtatattgggagaaaaagaaaagagagaaaaatagacaatctgaagtgatgagaagagcaaatgctacagatgtacctgaacctcttcagtaggtgtgatcctgaagagttgtgtataacaacaatgaacaaaaataaaatgtactgtggaaattgtctagctgttgagatcctcctgtgcgatatttttcaaagtgaaaactccaatcaaccctagcttatttatggagaagactttgccccacagtacccagaaagtttcttgacaatatcatatatgcataataaccctgagacaatttttgtttaccaggaaaacatataaaagggaacattaaactttgtctagttctactgcataaacatgtgataatgtgcatggtgaccttctgttgtaaatggaaagagttaagctctctgaatctactgctgaaaggtgaaaacactttcttagggctttgaacttcatttgaaatcttactgaaaaaacactacagactctattttctttatatttgaagatactttacataaaaatctaaagcattttgacttatgttttcatctacttgagaaggaaactcacagactccaaagcaactgttgtctgttttgaaaaaaatttcagaaatcaccagaagcaatagggagtggccttgattcctgttcttgtatttatgggtagctaaagttcatatttctcaacataccataatctctgtgtaattggccaaattccatggtggataattagatctagcttaccagggcagatttggatggtgagagcagtcacactgttctgggaatatgttagccaagtttactatgttttacatgagttgacagactcacctcacttgctgaaggactagcccagcaggttctacgggtgagatcactgctagctcattcactgctgggcctggtaggcacaagaggccaagaaataaataatgtgaatttgggcttcagaagttctctttcctattttctttcctaaaccctttcttctaccagctgtctaggggctaaaacatttgttcatacgtttattaactaattcaacaaatatttaccaaccatgtttcaggcactggacactagaaatataatagtgaactagacattttctgccttcaagggtctatgaacaattataatattctgaaaaatattacaattcacagagctcagtaatccaaatccttattatttctgtctttaaaaagcagaaagtgaaaaatgctcttaaaagaggatggcatagaaatgtatttatgcattgcaacagataaaattaaggaatgcatgaagactggttcatctgtgtggttgtgagtcaagaataaatcccaccctccctgaagtactcagactctaccttgccccatggccaccactgtggcccaatggaagcaccagtccagggggtctccattcatgctgtctttggatgtcttcagaatgttgtttcacaagtactcagacccaacagtaagattttaaaaattgtccataatattaaccttggcattattatgttaaagaaagcaaaacagatatcactgagtttacttctcaaaaaaaccttgcgttcctgcaaaagtttcttgaattctgactcttgtcacacaatcacacaagaatggctatacttaaacccttctaatcaattatatccttaatatgtatgactgagtgatgtgttttcatgactatgaaatgtatacatgtttggaaaatctattcacaatagagttttatgatattcctgttaacaggctgtcattgtaacactgtttatgcaggaattgtaattctatctgtttttatttttagcgtcttttctctccatcccccaaattttaaggagctatcaggtctgtattttatttggttttgaagttttaggttatttgtagttataatagccatatcaattattcatttagcaaacatgtattgagtgctactatgtgcttagatttttccaatgttgtgaaggataattggctaaaacttttccacttttattagtaatttgagagtttttttctccatggattttagtcactggtaaaggctgtttcatattcatagatttttttctacggtaagaaacatatgatgttgaataaggtatgaattacaaattaaggcttttccacattcgctgcctttataagatttttttttcttcatcaaaatctattcacacacacacagacacacatgcgctgttttgattttcttcaaatatatccagtgttcagttcttgggcacatattaatatacttgcctagatgaagactatgtgtcctcaggaatttataatctagcaggtgaaagatttgcttctttcaaaatgtgactctacttccccactccttaggttgtgaaagcagttgtttacgctttatttcattgttttccaaactttagttatttatgtgccatcttcatgattatgctattcacataccacctatactattatgcttctgaaaatatactatgattttcaacttaattaaatttgtttagtaataacagtagctgttacatcactaggttgatgtgctagttaaaaatttttaaatatactttaatataaatatgttactactaaattatttttttgtctgtatgcacccaaaatcttgcctttagtagtactacacatatcatgctttgggaaactctacccatgagattcatattcaagcatgaggaatggcaaaagaaaatacagaaatagtgatagtaaccatagcaatggtaataagagctattatttattgaggactttacgtatgtcatttaattttattttatcctcacaacaaattttagccatgagtatcagataaatatgaggcaaaagggcaggaaagaaggaacagtggaagtcaagctttttttcgcctaggtcagctataactaacacgacaagatgttttagtatttgtactttatttttagtcagctcagatttcacacctgactattttacaaaaatttggatgtgatggtggcagattaacataattacttttagcaattattatgggacaaattagttaaaggttgtaaaatgcctagaaacagagtagaatatcctagtaggatatcctagaatatcctataattaagttatcaaacaattactctgattatttttcacagtagttcaatcaaagtgtaactttgggtctgttagtatacatgagtgtgaatactctggagatttgatctttggctttcctgtgtaagttcatatatatttttgttattatcctgtaaataactgaattatagtacagtgattctgtaaaaaacactttagttattaatattctttggtgtgaagttcacattaaaaattgttatatttccagaacctggtttttacctgtgaaagtcaatgcatccttcttttaatcctctgcattggttttgcatagcttgatgaaatatgacttgcttctcctccctccccctccttcctgtgcctgtatccccatcatttttttttctattcctcttggtatctggacttctttttctgccaaatgagtcagtaagagaggaaatgtttaacccacatttgtcatcttggctgggaaagaagtttgaaggcaaaaggtgcctgaatatgtttcactaggatgctgacacaacctttttgactctctcctaagaatactactctatattcaagttataaagtgctaaatgatctatttccaccatgtatacatttcatatgatcaatacttattttgtaacttttttctttgaggagaagtatttttcttttggaaaaatattatttatttgtgtgtgtgtgtgtgtgtgtgtgtgtgtgtgtatttattttcttttaatatgtggtctccctatgcaaaggatttgattttataaacagaagcaataggattaagaggataaaggaaaaataggagaaggggaaatatgagtatcatgataaggtaaaaatgaattgcttgtattctaacatagaatagctactacctgttgagtgtttattatatattagacatttaagactaatcaaaatatctaatctaatgaaataatcactgttttgaatttgcttagatttagtagatgtagaaactgagacttagagaggtttatttactcaactccacactgctaattactggtgaaagtagaattttactcctctggttttctcatccagcacatcatcactataacccttatagtttgcttttggcacaagtattcattattaatggaaatgcatagtattatctcagcaaatgtacaaatagtttagcttcactaaactagtcaattttttttttctaaacatcaatgcttaggaagcaaaacaggctgggggaacagtagttgtactggtggcagctgtggtgctgatggaggaagtggtggaatgcataggctgctcatgctttttgccacaatgaaggtcaaaaagtagatcacttaaagtctaaagttaaccttgggggtcatattcttcaccaaaaactatgtttatacatatagacttagcagtatgctataaaagtgaagatatagcactataaaattccaccataaagtaaattgttcaagattgtggtccaagctcttcaaaatgctcataaatcagaaggtgtatttattaaacaatattttatatgtacctataataatacaatactatactacacaaattggacctaaaatgaattctcttgctatattaaatattaaacattaaataggcagaaattttgtttgcactggacttagaatataagaagaaaatttgggacaacctgaatagttgaggtctcttgagaaacccttcagcttcttttcctccaaataaatttctctgtagcaaatggaagccatccaaatgattccctagctacctcaaagtactgtaatttgtctacttcacaaagtggaggactatatctagcaataattcaagaaaaatgcagtgactcccattatatcttaggcactatgctaggaagtttatgcatatcattttgtttgattttaatagcaacttcatgaaataaatcatcataataaatcactatttcagatattgagaaaccacagaaagagagaagttaaataattttcctgtcaaagaccacatcaatgatgaagccagaatttgagctcatgtacttaaccactggactacctgcctgccctgtcgaggaacagctaaggttgtcatagagtcttgactgtgtatagatagttgtttgaagagagaaaaaaggcaggaggatctggggcatatgtttaaatcaggcattggcatctgtactagaattgaaaggtggaactattattgtgttctatttattgagtataggtataccatattcaatgtatttctctgcttcatacactatccaaggtgataaaagtgtttatgaagagggattaggaaatatctgctgtgtttaggtcatagtccaaccaaaggattaattaacatttgcctcttttttctcctacatccagtgtcccttttgatgagaagaataagcctcattctgattcaacagcagagatcaaagaaaagacttctgttttctggccaccagatatatgttatctgtgcttaaagaattgaaaaacacacatcaaaggagaattttcttggaaagagaggtaatgagatacagtgaaagagaatggagattctttaaatcacagagacctaggatcaaatcctgtgattagcactttttagtaatgtagcctacttcatttctttgagccctcgtttatttttctgaaaatgagggtgatctaaattacgtctggagtagtaataaagattaaatccatgtgatacaggtaaactcatgacaataatagacatgaaacaaatagtctttcatctccctcctttgctcaagcattgctctgctcttctcacctcctttcccttcctttttcttttctcctctttattttgtctgtacccaatagcttttcccaagccttaaaactatgtataggtatattgttgcagcaaaatgcataaaggagacactcattatttgcatccatttatatgctgatataaatatttcatcctcacaagtttcagagggaaagaccacatgctggtgatttggtgagaaagaagcaactatttctgtgatttaatttcaacctgagcattaaagaggcaccctttcactactagtggtaactccatgcttccaagaactaatgagctgaagaacttagcacttgtgatgaattagtcaagcaaaaattatgaagcgagtaatctataacattatagtacattacaaatgctgaaatatattagttattatttattatgattcttatagctcatttatactgtacaaaattcttctgtcattttatgaagatgttacacatatacataacaaaacttagctaattagatacaaagactatagaaccaaataactcttttctaaatattttccctttaaggaggttttgcaatccagctttgctgtggttagacactgttgatgagaaaactttttttttctttcttttttttttttagacagggaatcattctgttgcccaggctgtaatgcagtggcacaatcatggttcattgcagcctcaacctcttgggctatagtcgtcctcctgcctcagtcttctgagtagctgggactatttgatgtgcactcccatgtgcggctaatttttgtatttttttttttttgtagagatgggttttcaacatgttgcctaggctggtctcgagctcctaggctcaaggtatccacctgcctcagcctctcaaagtgctgggattacaggcgtgagtcagtgcgcctgacctggatgagaaaatattgagttggaaacccaaaatatgacataaataattggtatattttagagctggatttcaacaacttttcaacactgtcatcctgtaaatgtctttccgtcctaatcccattgcccatgcactcagcagaagtgtgtgcctctaaggtggatgctggtatgaaatatctcagctggggcaggctctgaaagggagagatctggttaaagtgctcataccaaacaaagctcctcatgatgctggcctaactctcccaatcctgcatttctcaacaaaactttttgctcttctctttcacataactcccgtggaataatttccattgaattgcatggaagaggctgttcatggggttagtctggcagataagaggtctccactggattttttcattttgcaatcagtttcatacatatacgtacatacttttcttggagtcatagttcattctcaggtcttttagagttaaatatctttcatttcttcttttaaggtcttaatttcttgtttttcgagtttcatgggagatatccagtcaccaatccaatccatatcggggaaaagtacaacaaatgagtgaaatttgtaaccaaccttggatgatggaataagacatttgggagaacacaggagaagtggggaggttaaggagggatagctctgtgaaaattttgcattactcttgcctgaggtctactcttccttgtcatgttggtggctgttttgacaatgagaaatatttaatggcaaacttagtcttctaatttgaaaatggaaatcataacagttcttgcctcttagggatagtgtgagacaagtgaaataatccatgtaagaggtatagtactatgcttgccattctttaagagctcaacaaatattcactttttacctattagtatcaatcttaattctaaaattctattatttaatattttccagtggtgtttctaaataatatctaatgactaggctaatacactatgtggttcttctagggttcaagcatcactgttaggtgtgctggaatcctttcccgagtcagtactgctttctagaagaaaaccggggagatctatttggaatgtatctaactccaaagaaaccatcagaggtaacaggtaggagatatgaaacgaccttttagatatgaaccctaattgaataaaagttgccaaacaactgttcccaaacatctaaagaagagttttagtctaagtggaatggctggagagtatgggaagagttctttcctactctgtccaaacacaagcctctgtgacatttatcaaagaaatgcagccctttaaatctgggtataagtccgaaaggtgctttccttgtgaagcttcttttgtcctctgcttttaggactctctgcacactgcatcctctatgtcaccctccagtacatctgctcttacacaaggggccccacagggactggcccacacaccagccagggcacatgggccaacttttaacagcaaaaggaaatgctaaatcctagagtagggcagatgagaaaaatggcattcttcagagagctgggatgactcacattaagatcaagggccctgaagtaagacagacctgagtctgaatctcaattccaacaataaatttgtttatacacttaaggcatcatgtatagtattgttaaatagatactttacaagattgtaactaagaggaagcaaaataatatctgtaaagcgtttcatagattggccagcatatagtaaacatttaataattagtagctattattatttttccttaaatattttttttctggcttcctagcaatcataaaatttagtcttgtatagactccatggctaggacttgcagaattaaaaatggtctgaacaatttagacattgcctttttgtcctcaaaccaaggggtgaatttttattctaaaatatccagattgtccatatcacttaaccagttgattgctaagtctgtatttctcttttatgcaattgggaaacattaaaaagttgaatgtatatactgtacacatacatgcacacacatagacttaagtacataaatgtgtatgtaccttccatagcacttagctcatctgttctttcctatgaccttttctataatcctgtgaagtaggttttatattatcctattttatgattaaaggagaagggaagacagaaaagcagcctggcttggccagaggccttgcaattgattacgtatagagccagggagtcctgaccccttttcagtttttcttcctctgtactgctgtgatgactgtggaagtgaagtacttctttggctgccaaggaagtcccagctgaaaggtaaccaaaggaaaggagtatttgggagcagcatggctgaaatccagttaacagttaaaatcccgttgggcaatttctcgttaattgacaacaggaattgctgtcactgtcctgtctagccactttcaaacggtggggatgttagcaagagctcccagtgaatgcttcctaggagagcagtgattgctttggctagcttcttctgtagcagttttctggcggtgaaaagtctgtactaagacaattggaggtggtaatcattttctaataaccacctcaggcttttggcacctaattcgctggcactgtctagggaagctccttatgctaactcatgcttcttgccatgtcaatctgcttatctaattttgctgggaaatctgatatcacccttcaaatagttcacctcagtgggatccagtgtgtgacctgcaaagtgctcaaggaagagtctgatcagctctgacaagcaaacagcagaaagaagttttgaaaaaacggctaccgtttttgcagctttttcactgtggttccatggtgtttgaaatcagaatgtaatattgagttaatgacacaaggaaacacttggatgttcatattgtctacttggttttcatgaacctcacatggactggcttcatcctgtttcagagtccattcaactgtaatttccactctacttcctgtgcaggccttcctctggtttgtgggctgtacatttcagcctgctcctttaaggggccccctgagctgaaaatgaaagagacattttgttgcttctgctacctgcttatcgtccaatcccaatctcagattttctttttctattttttaaacccgagtagcacttttccaactagtgtgtagtttttctttcaattctctgctcttcacagtaattaaacaagagctagcctccttttccaaatcttgtttttgtaatacctttattcccaaagagttatgcttataagagtaacataaatgtgttaaacttggtattgatttgatgatttcataaaccccagactccttgaaattctgcaggtttttgtgaaaggacttgcttaaaatctttgctaatctacctgaattttcttccaaaggcagttatatacaatgtttcttaaaactaattctccaaatttgcaatttggcagcatcctactgggactctagaaggctgataaatcatggagagtaggtattcatataggaactatgaaagctgtatgtagtaaacactacttaagaaggccttacatttcataaaaagttggagatttttgtggagactcataaaatgcatcctttatatcagtgaagtttttgcttctaggtatattatactcacatcgaaacactccagggattttgttttcagcctgcatataccacgtatatttattatctggatagataaattagacgtatacatttaaaggagtttgcatcagctgctgctaggaagtttttcttgtgttagttaagatcctgtgaaacaacccttgacatttcactagctgcacagtttgtaataaaatccattttagcctgaggttaaatcatgactgtggtcctcacatcatggtgggggatcctggtggccagattaaaggaaactccacattctcatttctgacttccctacaaccttgtattaagaccttaattgaaaaacttattgcctctctcaccaaaatatttcaaattttaatagtttcccccaatgaaattacaagtactattttacttttttcagtgcccttggaatttcgaggctggatggggggcttcaatgtctgactcattaagtgttctatatacaaagccctacatggtccctagagcatagcaggcattcagtgaatgaaatgaatgaatgaaaagctagagtcacattttagtgacctaactgtatattttcagagtaatgtagtgcttaaaaaaggacaatgataacacgtttctacaaagagatgcatgacagataacacttctcaagaagaaggaatttagcttctgtcatttgatctaggttttcaattacagaagcattgagaatttcctgtggctggataagggcgaatctttaaggcaagttgaagacccaggctgcccatgtggacatcaatactcccacagagcactcttcatgaagaaaagtgtgggcttgctgtcttttcatcaaaactcgtagaatttggctgactgcctggtttatcccaggacattagtcagcccacaaatcccgcatttgtttattcagtccagagcaagtgaatactgccattttctcatctcctttgttggcaacactttgttaacctgaattgggttctcaacataaaatgaagtgactaatcttttggggggttccccctcccaggttcttgtatgagcaactaaatctacacaccacaaagccccatgctgtcattttttctcatcctgcccctttattttgatgattccacattgtagttcatgaaaccaataccttctagagtgtggctgaactggcgccagcattaagaaaaggagtttccaaactttttagttttgtgagaaaatgttagaggaagagggaggttaggttgactatttatacttatgtaatcttctgtgaatttgcagtagttatcaccttgtactctcaaaagttttctagctctgagtatgtgaatctgaaagtgcaggaagtaggaatcttagcacaaaacaaccagtttggattatcacacaattaatatgggacggagctggaggatggacctgaacagaatgtatattctttatcactaggttatttatctatctacagatgtctagaaagacctgggcttttttagcaaacgtttgagaatctaggtttctaagtttccattgaccatgaaagagtgattagttttagaagacagttgggggcaacattgtgcaagtcagaagaggggatgaagaaaatcataaagctaaacatgtttgccataggcccaggctgtttttcagcatgtttcacctagcagcttggcagataattcccagtgatcattaggtctgtggaaattctgtttggtttataaagttttggccctgactatgtgtaccactgataacttgtttttctctctcttcccttttcctccaactcgtagccagagctaccttccagatgacttctttctaccactttctttcttcccagtgtaagagaatgcaagtatatgctgatgtttggagcaagaacattcaaaaattttcttattaacataacttctaatggaaatacagtatactactatggtgcatacaaagaagaaatagcaacatatatttgttttagacctgattgctgtattttattccttaggtcctccttgatgtcttgtagaccgtcactagctaattgttacagccatcgaaggaaaaaataaggatttttacttaggacatacgtaacagaaaaagagatggtttagcaaaaaagcacaggctttgcaataagcagccttaaattaaaaaaaaaaaagttaactcataactaactgtgtgacctgggataagttactgaccctctttagggcttagggtcctaatctgcaaaacggaaattataataataaccttagctagcatttcttgtgcacatactataagctggtgataaacaatttatacacactatctcatttaatcctcacaacaatcctgtgagataggtactattatcatttctattttacagatgaagaatccagacataagaagtgaagttaagtaactttctcaaggtcgcacagctaccatatgatggagctggaatgtgaatctctgcagtttgacgccagagtgcatgctcttagtcactacatttgtctacaaatctaaaacacgtaagacacataggaggtgctcagttagtggtatctattattaaatcagactataaataatcaccaggcaatacttgaaaggccacaaacaatttcttaggatttgtgacaatactaataattataactgattatgagcataccttgtgtcaggcacttcttttcatagtatttcagtcattatttaagagatttattcttatttttatttttctagtgagaaaactgaggctcaaaaaagccgacaaatttgtttaggattacaaaaatatcaaatgataggattgaaaatcaaatccatatcctttctatgtgaaaacctgtgttctttcagctttttttatttttatttttttattttttatttatttttttaaatttttatttattttatttttttattttataagcctttttatttttatttattttactttatttgttgttgctggtgtttttttcttgagacagagtctcactctgtctcagctcactgtaacttctgcctcccgggttcaagcaattctcctgcctctgcctcccaaggagctgggattacaggcacctgccaccatgcctggctcacttttgtatttttagtagagatggggtttcaccatgttggccaggctggtctcgaactcctgacctcaagtgatctgcctgccttggcctcccaaagtgctgggatttacaggcatgagccaccacgcccagcctgcctgatttttaaaattattaaattcatatttgttatttatcagatgcctctgccactttattttttaaaaatttatttttattaaggtatagttaacaaataaaaattctatatatttattgtgtacagtggaatgttttgatatatgtatacattgtgaaatggttaaatcaaactaagatatctgtcatctcatatgcatgccatatttttgtggtgagaacatttatgatctactctcttagcaatttttaatattctgctgtttgacttttaaaccaaggcttggattaggacagtctttgtagcttagttttaggttcagggataacaaaagttgttttatcctttgggcttttgcaacttgccattttcttaatgaagatctgggagaaaaattagtttaagtggtttttaaaatagccattagctcaggacatactcagccaaggcaggataagtagttttgccagcattcttctgtaggtaggttggttgttttttgtttttttgccacagtctttttaaaaaatataactttaaaaaaaccttggttttctgtgattgatctttttcactattttttatagagggccaggaatatgagtaaataattcttgggcttgggtgcagatgatccacgtgctggcagacagaaatctaaagggacaaaagaggctgtcctttgaagatacttttcctggcttgggttttatatttttggatttgatttagtgaaaatttttattgaggacctactgcataccagacactcggctacattatgagaggtttggggggcctatattggcatatagggaggatgaataaagaatacaaacaattatagtacaaatcagaataaaatttggcatgcaacgggctatcagatagtatggaggaagaaagcatattttattagtggagctaggaaatacgttacaaagttgatagcattcttgatgggtcttgaaggttacatagatttttttttctttttttttttttgagacggagtcttgcagtgtcgtctgggctggagtgcagtggtgcaatctcacctcccgggttcaagtgactctcctgcctcagcctcctgagtagctcggattagaggctcctgccaccacatccagctaatttatatatgtgtgtgtgtatatatatatatatatatatatttttttttttttccagtagagacggggtttcaccatgttggccagactggtcttgaactctcgacctcgtgattcgcccgcctcggcctcccaaagtgctgggattacaggtgtgagacaccacacccggcggatagagagaattttgacaggtgaggaggtattccaatgcaaaagaataataggagcaaaagcacagtggtgagaaattggaggggaactgtgaaaattgccacatagattagaggcaggaaaataaaggacggctaagtttatatagtgaacagtgagccgcatggacacaggtgactgttttctcctttttgaacccctgcttactccagagtcaccacctctcctggctttctgccaatcttcttggccacagtttctcggtcttcttttctggcttctcttccttggcctgaatgctacatgttaagtgatgtcagcttcagttttcttaacctctcttctcttaagttgctatcatttaaatatctttaaatatcatctacatccaagtgacctctaaaccagtaattttacccatgacccatctcctcaactccggattgtatataaaactgtctactcaacatcttcacttttgatgtctaaatctctatgtccaatttagaattcttgattctttgctttccctccctcctggaaatcctgctcttaccagtcttccccatcttaattaatgaacctgacattcacctagtagcttagtcctcaaaactagggattaatctagatttagtcatttttcttactcttgccatataataacatattattctgagtttacctttacccgaccccaaataggtaactgctgtttttgttataagatagtaatatttgcctctgagtgtatgtgaattattttgataaaaataaatattatttttaaaatattaattttacagggattgtctcttgatttctttccaaaagttaactcataagttgttcagcagagctatgtattcttcagtatgttataatttcgttccatcttccaaaaggccttcacattctcttggcttacagactcagatgctatggattagatacacaagtacatgttcctgtatatctattatatagtgaacataacaattatgattgtgatcttccaaagctcgtatttttaatcaaaattaattaaatattttaagccaaagaataaaggtagatgcagcatctagtcaaaaggatatttctgctggccacactcaggaagacataaagatatagttgtagaaagtgatatagtattggccaggtgtggtggctcacacctgtaatcccagcactttgggaggccaaggtgggctgattgcttgagctcaggagttcgaggccagcttgggcaacatggtgtaaaccccatctctacaaaatacaaaaattagccaggtgtggtggtgggcacctggagtctcagctactcaggaggcagaggtggaggattgcttgagcctgcgaggtggaggttgcagtgagctgaggtagtgccactgcactccagcctgggcgatagagtgagaccctgtcttgagaaaaaaaaaagcaacccagtgataggctgggcaaggtggctcatgcctatatttctagcagtttgagaggccaaggcgggtggatcacctgaggtcaggagtttgcaaccagccttgccaacatggtgaaaccctgtctctactaaaaatataaaaaattagccaggtgtggtggtgggcacctgtaatcccagctactggggaggctgaggcaggagatttgcttgaaaaaaaattagccaggtgtggtggtgggcacctgtaatcccagctactggggaggctgaggcaggagatttgcttgaatccgagaggcagaggctacagtgagccgagattgcgccattgcacttcagcctgggcagcaagagcgaaactccatctcaaaaatgaaacaaacaaacccagtgaaaaccagtattgaaaatagattgcctctcccttgcttcatggtctgttcttacgtaattttcaagataagttcattttggcgggtactgacaaatttccatttatttacttttttcccttacattcatttcttctcagtctctccaatgaacgccttcactgatatccaaagcatgaaggacacaccagggaaaaacatagacctaacacaggacaaatggaattattagaaacattttctagcagaagaacactattctgttgccatttgaatctttgcttctttctaggtttgacaatgagcctatcatataagcccaaatgtaaacagaaagaggttgaatcagtcacgataagcccaattatgctgtggtaacaaacaacctcaaaatctcattggcttaaaatatacagaattattcttactcatggcacatatccatctatcatctgcaggggatctgctcactgaagtcacttaggaacttggactgatggaacggccactttttggtcactatatgtattaatctgttttaatcctgctgataaagacccaaaattgggaacaaaaagaagtttaactagacttacagttccgcatggctgaggaggcctcagaatcatggtgggaggcgaaaggcacttcttacatggtggcagcaagagaaaaatgaggaagaagcaaaagcggaaacctctgataaacccatcagatcttatgagacttattccactatcaagagaatagcatgggaaagactggctcccataatttacctccctctgggtccctccctcaacatgtgggaattctgggagaaacaattcaaggtgagatttggtggggatgcagccaaaccacgtaatttcacccctggcccctccaaatctcatgtcctcacatttccaaaccaaccatgccttcccaatagtcacccaaagtcttaactcatttcagcattaatccaaaagtccacagtccaaattctcatctgagacaagggtagtcccttctgcctatgagcctgtaaaatcaaagcaagctagttacttcctagatacaatggtggtaccagtattgagtaaatacagctgttccaaatgggagaaattggccgaagcaaaagggttacagggcccatgcaagtccaaaatccagcgaggcagtcaaactttgaagctccaaaatgatctcctgtgactccaggtctcatatccaggttatgctgatgcaggaggtgggttgccatggtcttgggcagctccgtccctgtggctttgcagggtacagcctccctccaatctgctttcaccggctggtgttgagtgtctgtggcttttccagatgaatagtgtaagctattggtagatctaccactctggggtctgaaggacgatggccctcttctcacagctccactaggcagtgcctagggactgtgtgtgggggctctaaccccacatttctcttctgcactgccctagcagaggttctccatgagagccccgccccagcagcaaacttttgcctgggcattcaggcatttccatacatcttctgaaatctaagtggaggtttccaaacctcaattcttgacttctgggcacccacagggtcaacaccacgtggaagctgccaaggcttggggcttccaccctctgaagccacagcctgagctatatattggcctctttcagccacagctggagcagctgggacacagggcactaaatccctaggctgcccatggcgcagggaccctgggtccagtccatgaaaccactttttcctcttgggcctctgggcctgtgatgggaggggctgccatgaaggtctctgacaaggcttggagacattttccccatggtctcggggattaacattaggccccatgctacttatgcaaatttctacagctagcttgaatttcttcccagaaaatgggtttttcttttctattgcatagtcaggctgcaaattttctgaactctgtttcccttttaaaactgaatgcctttaacagtacccaagtcacatcttgaatgctttgctgcttagaaatttcttccgccaaataccctaaatcatctctctcaagttcaaagttccacaaatctctagggcagaggcaaaatgccaccagtctctttgctaaaacctaacaagagtcacatttgctccagttcccaacaaattcctcatctccatctgagaccacctcagcctggattttattgtccatatcgctgttggcattttggacaaagccattaaacaaatctctaggaaattctaagcattcccacattttcctttcttcttctgagcctttcaaactgttccagtccctgcctgttacccagttccaaagtcacttccacatttttgggtatctattcagcaaagccccactctactggtaccaatttactgtattagtctgttttcatgctgctgataaagacatacctgaaactaggaacaaaaagaggtttcattggacttacagttagttccacatggctggagaggccttagaatcatggcaggaggtgaaaggcacttctcatgtggcagtggcaagagtaaaatgaggaggaagcaaaagtggaaacccctgataaacccatcagatctcgtgagacttacttcactatcaggagaatagcacgagaaagatcggccctcgggattcagttacctcaccctggatacctcccacaaaatgtgggaattctgggagatacaattcaagttgagatttggtagggacacaggcaaaccatatcactataccacaagtttttttaaaaaaacaaacttttgagaatcttgtactgataattaatatctggtctggaagtgaagcacatttctttttcttgcaactgattggccagaaccagctagatggccccaccaagccaacattgggggagaactgaaatatttggcaaacagcaaccatgaccatcacagctggaagttctcagtctggaactccttccccaggcctcccatttctggaactctgagaacaacaatccaggaatctgatgacatcttttcctttactagccaaaatctgatgacattttttcctttactagccaaaagggagaacaataagcaaataaattcaattttctcccatttatacttttaaatctgagaacgaattgtgtgtttataagaaagtgagggttgagcatcatgaagaaaaatataaagatctttaaaaagtatatattgggcctattagctacaaacatggatcattattaatatgtgtctgactgacatttaaaatgcataatcaaaatcaagcctgttagatacaaaattcatccattaatagcaactaaatttcattaggtaagtagtagtgctatgtttaaaagagtaatctatttggaaacaggaattaatactcagaatattattattaatatatttgaaaattacttgtgtttatttgtcccagcccttacaaggtgtgtggtaatggttaaggtatttctcctctatatgcctgagttttcttctttacaaaaggggggagggaataatagcacctgattttacttttgttgtgaagattaaatttgtacatatataaatctatatatctatatatacacttatatatgtatgtaaaatatgtaggcttgtgcctgacattaaatactaaaaaatactagctattatttttatcctcatattatcagatatgacacattcataatttaaacagaagcctacgaagaactcataaattaaaagaagataatcttttcacaaggtaacaaattttggaacaattttttagagtctctagacatctgttactgacgttgtgagtgaaatgggtctgtgaagggaagatacaggtggaactgggccagtgtttgcagaggaccatgatatttctatatctctgctggctccctatcagttctagagctagttcaagtgaagcctccataacctctggacaataaaaatgcaccatgctattgttagcatgatgaatgaatttatttttgtttagcttacagaaagttagtagttttcaaaagggtctttatgtatacaattgaagatactacattcttgaaaaggaaatctttacagcatacaggtccctggcactaatacctcatttctgggcacagcttgatatggaggtatagtttgtgttttatctgaggaaaatttaggttggtgttatgttttgggctagctctgctgaaacattattctcttttcttttagagccagggctgtgggctgtgtcacttgtgacttggcagcccttaatggggctacatgaggaagacatttccttacatgattccaagagtctttctctggggttctgaggtagtctctgtgtttcttggagatatcgttggctctaaaatttcccctaagtgaggtgatattctgtcatctcatgcatgggttttggaggctgaggggtgtctgggttggctccaccacctaccagttgggtaatattgtgtagttttttttttaaacctttctcagctttagtttccttatttgaacagggttaaaaattgggcttgagagaaggattagagataatattagtagatattgttgatgaattgggcgaagcagagggagggggcaaagttgactacctttgtttctgtctcaaacaagtaggtggtgatgcctttgaggagataagaaaagtgacttgtgtgtgtgtgtgaaagacagacacacacacatatatatatatagagagagagagagagagagagagacttataaattttggatatatggtttcaaggcacttttctggatgcataagtgtaaatgttcagttgaagttttaatggtgcttaggagagagatgtgaacgataatagagattccaaaggcctttacatcaagaggataactgaagctataggagcagatgaggcacacctgtaaagatgagacaagaagaaagcctagggtagctctgagaactttgctatttagtgtcctcatagaggggatggaggattcttcacaaaaagttcagttttgtgacaccacattcccctgattttactcttacctcttgagacaccaattttttaatgaagaagaaaattatgttgcctgcttaaagtaaggaaagcaggtgttggtgggattccttaatagaaatatagaggtttaaaatacctacaagagtaggagatagaattgatcaagtaaaaaaattgaagagattaattgaggacttaacatcagagaccatatgtttgttgtgacaataatccaaattattgtaataatgtgtttaggagtatttagccttgtaggtaccaagattgcattgatcctgtgttaggagtttgccaggtgtgtgcaatagtgagaaagacatgaagggatttgaggttgctgatgagtgaccagtttagatgacaactactgtttcttcaactctttcttcaacttcaactgtctgttttgggaaaggctagtggcctgtgaggaaacgaagaccccggagctggaggactcaaagagtttggagagcagacgtgtgcaagtgagggttttgtgagcactggaggacaggcagctggggaagagagtgtgttatttgcagttatgatattgggtgtggagctatttttggtggcagcaaagctcaggatgtatttttttattattcccataggtgatggaggctttttattttgccacaaaaccactggtgacgttgcctgtggccaccttggagaagacactggaggtacacaggatgtatccctggaagtggcagggggtataagtttagtaggagatttgttactgagtatttaaggtctaggaacagattgagggtgttgggtggattgcccactaagacactgggttttctagcatgatgacagaaattggagtttggggggagaagagttctattgtgtcttgaagaatgtgatcaggaggtatttctaatgacacaaacatagaagtatacacactggtatagtcagatggcatgagtaccaaggtggaagtgtggtggtcctaaagtggcattaaggagccaataaattgtcattcctaccttagctctgtgtcagatgaaatacacagcatagtgtggggagaaaatgttgggcttattggggatggggtctttcacataaaggaagaaggtttcagaaggcatagtggtatgaaaagaggagaaaccaaagggaggaaggtcaataaagggttaagaacgaggggaggcaaattgactttctttcagcatatgaggattataggaatggaaaccttaattggaattaattgaccacaaatattccaaagatggagtgaatcagttcgagacagagatatctgagggtctgagggtctgaagtaggatttgtcccagtcgtgtgtgggtgggttcactgtgtggagcctggggtcttgaggatctgaacatgggctgcctcctgtgtgcacggtggaggcatctggcctgttctccctggggtggactcatgatgagctgagtggccaaacacacaatggttttcatttaacatctcatttctagcctaacgacaaacctaaaaggtgggcataacaataatgttaataaaacatctgcatttctcccatccttggagttgtgaggatttaatgcaattgtttgtgggaaagcactttaacaactctaaattacgatatatatgctaggttttattgttacccacacctttgatgtatttctctttgtactcttcactgtatctgtaacacattccctaggataattagggctaccctttaacaaagccaagattctatttatagtggtaagctggcacctgggctgattctctctagtgattatgtagttttgatgtggactggcattcttccctggagtttgagtacctccgtcagcacttctcccgtccagaagttccatctctgtgtttttctattacaaagcccagacacccatctaggccacccaccaggttcctctttccagtcttaaggacatctttagctcctggctcatttgtgagatggagtggactgacatgccctaagcaaagattgccagcctggtctagttttccaggtctcccttgactcgacaataaagtaaccactagactttgagaattgcagttttacattgtctagagtcttctagactttcatgaagataggcaaatatgattctaaccaagatgtattaatacctcctacttcctttgaaatgtaactgagactgtacttgagacgttacaatttcttggaaggggaaaggaagcttctgctattgaacgaactttttgttaaggtagctcccaagcaggttcagtagctttgttctattatcacttttctactgacagtgatttttttcctttgaaggcctgggacatggagactgcttttctgcagaaaccacatcccttggagtaatgagctacacctacctcaattattcagtgcagtacaacactccaggtcagctattaagaggtgcacacattatttttagaaaatgtgagtcagtcttggggaaaacaaatctatgctatatgttctttttactcacttgatttacaacatactgtgatgtattctttttctattcagcatctttttgtacccgtagctctttgttctgagcataaatgtgaccttttggcttcaggtagaaactctgtctcatgagcactccctggacacggaagttctttgaaatagcattgattttgtttaagccttcatgttcccctggaaggctgattaaccttagtgccttctttctgtaatagctcatattgaattatctccctctgtctgattatatccatttgaatcacctgcaagtttcttttacatgtctagagtgaggacaatgtgggtgatgaagagctgaaatcttctaggtaaacattagatttttaaaaattctatttttttttttttatttttaagacagggtctcactctgtcacccaggctggagtgtattggcatgattacagctcactgcaaccttgaactcccaggctcaaacctgagcagctgggactacagatgcaccaccatgcatggttagttttttaatttttttttgtagatagaggttctcactatgttgcccaggctcatctcaaattcatggcctccagagatccacctgcctcagccttccaaagtgctgggattacagacatgagccactgcactaagccaaaaactcttgttcaaattacattttctgccttagtaatgctgctttcctagcttctgagaatttctaagacccaatggtaactctatgctaaaattaaaatacgaatgtccttttcaaaactgcacaatatctttgctattgtcaataatgtctcaataaacataaaatagcaaagagattgtgcagttttaaaaagaacattcgtattttaattttagcatagagttaccatcgggtcttagaaattctcagaagctggaaaagcagcgttactaaggcagaaaatgtattcacaatagcaaagacttggaaccaacccaaatgtccatcaatgatagactggattaagaaaatgtggcatatatacaccatggaatactatgcagccataaaaagggatgagttcttgtcctttgtagggacatggatgaagctggaaaccatcattctgagcaaactatcgcaaggacagaaaaccaaacactgatgttctcactcataggtgggagttgaacaatgagaacacttggacacagggtggggaacatcacacaccagggcctgttgtggggtggggagaggagggagggatagcattaggagaaatacctaatgtaaatgacgagttaatgggtgcagcacaccaacatagcacatgtatacatatgtaataaacctgcacattgtgcacatgtaccctagaacttaaagtataataataaacaaaaaaaaccactgcacaatctctagtattcagatggagactaagcatgatttttcttataaaagagcagatcagaatgttgtatcttttattcagaagactggagttaatcactgttatctttagtacttagtgctgccaaggctgtgtgttcacaatgaggataggatgtcaaataaatgaagcttcatagaacaagagcaggattgagtcatgtaggcaactgtttcagcttcctcacctaacttagcaccaaaatgtgttattgtcattacagagtgcttatttaaagaaaaataaaaagaacacacacacacacgcacgcacacacacacgcacgcacacacacacacatgtagctacatgtctaggaaggatgtggagagctgaaatatgaaggcaaaataaaacatctttttcaaagtatacagcctacagtggttagcacagagctggccacatagcaggggtttcataaatgcttgttgattaaactcttttttttgaaaacaataatgtagaagcaaagagcctaaagtgttttcataaatcttaagtggtagctttatgttccagttcagcaaaacacaaatttgaaggcaatctgtacgttagggttcaggtgaagaaggcaaaggaatcaatgaaattgtaaaagctttccaaatttgccttttctcttaagattgtctttctctcattctcttctccctatttcaggaatgcaaatatcctgtttcatcaatcttttgttttctgactcaagataacaacaataatttattgagcacaaaccatgacttttgggtctgtgtagccccgaagcttcatagttcaatatctgacacataagaggggcttactctacacttaaatgttagttttgtcctcacttttttctctttctcagagatctcccttttcccctacttgtataagcatgaagaaatctttcttttcattctctccaagtttaatcagacaactccacatacatacatctttgttcacaactatgaacaagacagaaaagttgctggacctcaaggactttacaatcaatctgggaaggcaaacattgaacatataatgtccagtctgataagtgttagggaaggaaagctcagaatgcaagggaatataatctaatctaggagatcgtgggaaatatcactggggaatttggaactgaaagaaaaataagatttgattaggggaaattgaaggatcagggagtcaggcggagaagaatgtcccggcagatgagacactatgtaccaagcccgagtttgacagagagcgtggtttacagaaggaatctaaaaggtgtagtttctgtagcagaagtgtaagggtgttactcgtaggaggcctctattgaactcttttccagtgacgtagtgtgtggtctttaagtggctttgcaatgatagtaagatcagcattgcattactgaatgagctcctttagtaaacgtggatatgtgctttctgaatctatttgtttgtttttcccaagtcataaacagtgaatcaagcaaatgaaacataatcaagcttggatagtatcttccactaatttccttggtcttaagtaagactgacagtaaactgatggtcaacctgttcaatgggctttaacaagtagtagccacatccaagtcaacaaacagtacaggcaatcagggcccctggcctacagtgaatcatgggaattaccccagggacctatgctttggggactcgtccttcctggcagctatagatgccatcagaaactcatttgcacactcttataaccaagataagggcaatggttagtcccctgtcattgcatgttagctttctttcccttttctaggctttttcagatgcctcttttacattattacttttcctgtgtgaaaataatgcgtgggaaatgggtaggtcatacagagcgataatttcattcctgggcccctgtcttgcagctccctaagtaaagttttgcgcctggcactcctctggcatagtaacctctgacaaacccttgggtaatagaggagtagcaaaacccatgggtaatggaggagtagcaggaatattatgattagctaacaaattcacaaagtacatagaaatttttttctcgaataaccactatagctgaggaatatagattagtgacaaaattgtgcactcaaccaactctattaaaagtatttcattattcccgtgaaaaaactcctaggaaaatgattcactgagagatatacgattgtataagtattgagaaacagtctttcttttttgctttttatttatttatttaatagacattatagttacacataattatgggatacaatttgatggttcgatacatttttatgttgtataataatccaatcaaggtatatttagtgtactcatcacttcatgcatttattattcctttttgatgagaacattcaaaagcctctcttctagctctttcgtaatatcaataccttactgttaatcatagtcactctactgtgcaatagaatgctagaatttattcctcctattgaattgtaactttgtacctgtcgaccagcctctccccatcttcttccccttccttcttgcttccccagtctctggtaaccactgttctattcctttttttgttttttctttttgcagagttcgctctgccgcccagactggagtgcagtgcacaatcttggctcactgctacctccgcctcccaggttcaagtgattctttctattttttgggaatgtgcgttatctaatacttaggtgcctcagatttaatggtggtaaatctcactcattttatgaaaaccaaatgaacactatcctcacaatggttagaaagcaagatcagctcaactttatgaaaatatgactataaaaccatttattattgccaagtggttggagtggagttgacagaaagatgcattattttaaattgtgttttagatgacagaacaggagtcagtaatgttccagtttggaggaattagagttaattggttaattgattgattcgattcagtcaaatttattgaatgactgctgtttcagacactgtatttggtcctgggaaaacacagataaataatatataattgtattataaattaataaaatagttttttccctccaaatgtcagtagtccttggaaaggacatgtaaacaatgaatataaagtgacacatagtccagtcaagataggtaggaaggtctaagtacaattgagtggtcaatttcacttcagggaagggcaatgatcagggaagatttcccagggaaagtgatgcttgggcaaataagtaagcattttacaaagagacaaggaaggatagggcgtcctgggcagaggaaggagtgtgtacaaaggccaagtgacatatgacaacattgtacatgaaggaaactaccatcaggcagagctgaaatgttggcacatggtgaagtgctagttaccggtcccagccatgacagtagtgtaacaaatgcctgcctctggtgcacagcaagatattaagattcctcaaaacagttcatatattttataaattaagatagacattaacagaagctcatagaatcaattaatgcaaatgtaagtgacctaagaggcattttgttcagcatagttattgattttgcctgacccagaggatttgaatttaggaagatgtaagcctagagtagctgtcagttatcttgtgatacatgggccttggaagcaaggtacagggacacagtggaccaatgggggaagattaggtcctggtgatgtgattcaagccactggattaagccacatctgaaacgtctatttctgtactcttcagttacaagagatgttagtttgaattatttgcttaagtcagtttttaaaaaattcaattgcaacttaggagatacatctggcctcttcattttacaacttaggagactaatatctagtatgacaaagtgacttgccaccaaatggctggttaaaaactgataccaggacccagatctaatgactcagaggccaggcttagaaatatctagctttttttttttttttttttttttttttttttagacacggagtcttgctctgttgaccaggctggagtgcagttgcgcgatcttggctcacagcaaatttttaaagcatctacatgtgagggcctaagtatacgagtacctagaaatctattttgcagcaactatatatttgatagagtgattgagtttagtttaaagatgacatttctaagtggtagtgctgtcaaaagagcattgcattgaatcaagaatctggcattctgtgttcatagttcacttttgccactaattatttttgtgaccctgggtatttctttctgggactgtattcattggatatgagtatctctaaatcttcttcaacttctatgattctaaatggaagtacactcaattttcaagtatccattgtggattttatatactgctatgtatcctgagaaaatcttccttttgaattatttttcgtattaatgagttcaacttcacaaatatttactgaacaccaactatgagctaggtgatgtaaaagtgaatagttacttctagtcagtattacttacttacttttgtattccacagtgcagtttgatattgtttgtagttccaaagcattaaacaatgccttttaatctaggacatgtggaatcttcaaataagagcagaattacaaagagttttagactgccactttgcatcattctgagaggcaataccataagtgttcagcagtcagaagaagggacaggggaaagtcctgagcagtgcaggtggattaagaactaaatatgcctacaaaagcacattcatgcctaaatgtcattgcatttggatcacaggccttgagaagatctgtaccatcactgtgggtaacttgggcccatttagagtacttgcctctgagggaaataaaaatttgctagcaattttctctaaatgacattatcataggcacttaattccttgataggttcttttagataatttttttataatgaagcaattaatttgattcacgaaagtaagtttctagtttatataaagaccagatctggcctatttcttagcttgtctacatttgagtagttccattgctggaaaatgaccctggagcttttcaatctcatttgaagagtccaggggacagacagagacactagttatgcagtttactagagccaggttccatttcatctctaataatttttgcctgtgtgcgcctgcacatgtagcttaagctatctaagccttagttagttttgtcatcagtcaaaggggaatagtgatatctccctctaagggttgtacaacatggtggttatttatagcacagcttgaataaatgttattagatgatatagtctcagtcaggttttccttggaccatgttttagtgacatattagactccaaagaagcaaaatgctaggagcacaaggcagcctaacttgtgagttgatgtacagtgtgaagatgcaccacagatttagaatttcagttgactagaagaataagtggtagaatttgtccctggttgactactgtcttaactttgtgtctttggggaaatatttaagctctccagacttctatttcttcatgtttaaatcgggaataatattcctttctcatttcgtagaaattgaaaggagataagtatgaaagcgtttatgagagtagaaatcatgagtgtgaaagttcatgctattatggcacaattgatgttgaaagttaatattacagaccattccttttttgcacagtgaaaattgttttatatccatattggcccctgtcacatattaaaatattattttctcttattaatttctatgagaataatactgccttcatacttttataaagggacctaggaaaccaatatttgtctaatgtttcaggctaaagagtaaaaaggaataggtatactcttgaaaatagatggctattgtcaatatttttcctaccaagaaaataattccttctctataaagaactgttactgtttagagcaatattttcacgattcaaaaagattatctgagcatgtgtccaaccataactgacccctgcaaaatatttctaaaagcactgtgcatctaggctgggaagtatgcaaaattagcaaaaatcccctagcattttcacaccaagccatgtgtatttaatatacaccacctcaaagaggaacattaccaccctagcactatgagtgaggtgagacagagagatttctaagaatatatgggtgtaattttctgttaactgagagtgattgacagttcgtggaaatctgccctccaaaataacctgttttgcagcacccttagttttatttgatatgaagaaactgcctgctgttttgacccatttagctactaggaactctatttactaccctaactgcctaaatccctatggataaattaggcagtatctgtttattttagtttagatttatttttaaaaccagtgttcctttgactgttcttactatttctatttgagagttggttgaaataagatcatgtaaataaaaatacaatgtagtctagatctaaagtcactgtacatacctagataattttttttttttttgagacaggatcttgctctgtctcccaggctggagagcagtgttatgatcacagcttactgcaacctctggctcccagattcaggtgattctcccacctcagcctccctagtagtttggactacaggtgtgtgccaccacacctggctaatttttgtatttttgtagagatggggttttgccatgttgcccaggctggtctcgaactcctaggctcaagtgatctgctcatcttggcctcccaaatgagaaggattacaggtgtgaaccactgtgcttggcacctagaggatttcaataaaatttgaggtcctataattttaagatcacatttccaaaggaaggagttttgcttcttttcaaatgcatggacaatgagcaactatattgttttggtaaaactagtagtcccaaataagaaagaggtcctactagtccctagtagtctagtcccttgactagaagaaaaagtcaagcccaatttattttatctgcaggacttggtttaagggggattataaaactatcaccacataaagtctttgatgaagaggacatagggggatgtagggagtacttcagagatgcatctggtcactctcgaatacataacacatttacataaatatatatatccaagtaaacttcagacttcacatatttgtttccttttgtttccttgttgaaaatctttatccaagctgacaatcacagtacactgctcatgtagattccactgctgagagctggaagctgagagtagagtgggctggggagcgactttcttgggactattatgcttttcttgcactttactaggttcctgttcttccccacccactacctctcctgggcactgattccaggcaagtgagatgcatatctgtggactatggttaagtgaaagcctttgttctggaaagctctatctggtttctcttaagccagacagaccagcttgccatgaaggctttcataggctctggtccacactttagacttccaactggtctgctactgacattctaggctattgtttctccaagtaatgaatgagtataccattggtggtggaagagagaattttagatggtacatagacaaatgtttttattgtgattgttatgtatttttaattcatatgagaaaaatgttttccattcatggtagcaatatacagtttcttctttaaatacatttacttaaaaatgtgagttgatttaaagagaaatattaataagacttctggggaaactcaggcatgacaaaatacatgaaggtgacatgtgagtagttgaggtttagaaagcactgcaatgttatagactctaggctagctccctgcctatccccaggccagttaactagttgaattctctcaagagtcaggatgtctttgcctgttggccttcaccttaagaaagtcaggcaatgatgaggaatcacacctgaggagattgtaggagacctttaacttaaagagtggtgatgaatatgaaagaaagagtcatagtatatgatcaaagcagagaggactttgagactcagcgattgggatgtaggaaggtttcctgtaaaaataaagtcttaactgggcttcaaaggatgaacaggaattatcctgtggagaaaagtaggagaagaatgacatatgccaagtttgtttcttaaaaccacaacccccaaattgtgagctctgggtcttaatttggtggggatgggaagcgccaatctatctgtgacttctttcctgacatgggctttcaagtgcatgtaacttgacatttatgatttcctctgcaaaagaagaaaggaacagggtgatggtgcctctgtgatcagttgcatttatgggtgcaacagcaaaggaggtgggacacctaagggacaaccgttcacgtgaaatgaagcagggatgagaagaaatgcccgtttgtatttaatacatcccagaaatgaacccctttattttctgggactgttagagcagggaaactatatatttctaagaatgggggctctgctcaaatctttgtattacagtacaaagaagggtgaggacaggaagcagtggtgatcttgctctttttggaagagtttgtgtctgtccttttaaagtcaggtatgattgataggaaagtcaagtactggcatcctcagattggagaggttttattttattttattttttttaatggagtcttgctcttgtcatccaggctggagtgcaatgccacgatttcagctcactccaacctctgcctcttgggttcaagcaattctcctgtctcaacctcccaagtagttggattacaggcacctgccaccatgcctatcttaatttttgtatttttagtagagacagggtttcaccatgttggcccggctggtcttgaactcctgacctcaggtgatccacccgcctgggcctcccaaagtgtgggattacaggtgtgagccaccacacctggcctgagtttaacataaacaaagaaataaaaataatataatctctcaaaatagcaaagaacagggttgtctaatcaaaatatataactatttatttttaatagccacattacaaaagtaaaaagaaacaggtaaaattaatttaatttaattttaaaaatatattttaaggtatacaacacggtgctatgggtaaaatggttattacaatgaaacaaattaacatctccatcatctcacatagttacctgcttcccttcccactccaaacccctcattgcaagagcagctatagtttactcatttagcaaaaatcctgaacgcaatacaccatttttattattttttaaatttatttttttgagacaaggtctcactctgtcacccaggctggagtgcagtggcgcaatcttggctcactgcaacctccacctcccaggctcaagcaatcctctcacctgagccttgcgagtagctgggactacaggcacgggccaccacatttggctaatttttgtagagacagggtttcaccatgttgctcaggctggtctcgaactccttgggcttaagtgatctgcccacctcagcctcccaaagtgctgggattacaggcatgagccatcatgcctggcctacaatgcactaatattaactatagttggcaggttgggcattagatcttcagacttgttcatcctacatatttgctactttgtatcctttgaggtacatctacccatttcctccacccaccctacctctggtaatcactattttattctctatttctgtatatttgacttttaaaaaaattctacatatatgtaaaataatgcaatagttttctttttgtatctggcatattttacttaatataatttaaataatatacttcatttaactcaatatatttaaagtattttaacatacaatgaatgtaaaaatattgaaatgttttgcacttttttcatgtaaatatttaaaatttggggtatatgttatagtacatgccatttaggacattaaattgccaatggaaataatattcagattttataacatttgcagttgaaaaagtagatacatgtatccaagttgctctcaacatacttaaagttttccaataactgaattaaatatcagtttatcagtttaatataaacaattagggtaaatgaaaataaaatttcagctctttggttccattagccatggttcaggagcagaatagtcacctgaggctagtgacaacgcttttggatcacaggaaagaagaaaaaaaatcaaaataatttttcttggtcacatttagctccttttcttccaggatgattacggagctaggaatttcctacgaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaat

SEQ ID NO: 1120 - DNA, 83101 bp, Homo sapiens; identical to SEQ ID NO: 1119

SEQ ID NO: 1121 - DNA, 83101 bp, Homo sapiens; identical to SEQ ID NO: 1119

SEQ ID NO: 1122 - DNA, 83101 bp, Homo sapiens; identical to SEQ ID NO: 1119

SEQ ID NO: 1123 - DNA, 126305 bp, Homo sapiens; identical to SEQ ID NO: 1116

SEQ ID NO: 1124 - DNA, 126305 bp, Homo sapiens; identical to SEQ ID NO: 1116

SEQ ID NO: 1125 - DNA, 126305 bp, Homo sapiens; identical to SEQ ID NO: 1116

SEQ ID NO: 1126 - DNA, 126305 bp, Homo sapiens; identical to SEQ ID NO: 1116

SEQ ID NO: 1127 - DNA, 126305 bp, Homo sapiens; identical to SEQ ID NO: 1116

SEQ ID NO: 1128 - DNA, 83101 bp, Homo sapiens; identical to SEQ ID NO: 1119

SEQ ID NO: 1129 - DNA, 126305 bp, Homo sapiens; identical to SEQ ID NO: 1116

SEQ ID NO: 1130 - DNA, 277548 bp, Homo sapiens
tgaatttctagtaaaaactttgaagatgagctgttcttacttttcatttctccacttatggagaagatggaataatgacaccaaaagtactttggtttttttcttttaaaaataatttgctttcttttgcatgccacaggacagatttctagtttcaaaacaagggtacaacaagaacaaaaaaatccccccatccccaaccgtctttcaccaatacaagaaatccttctggaaatattagcaagcaactaaacaggtattgaaccactgaatctacaagttaatacataatctgttatggcagaataaccaagaatttttccccaaagaaagattttaattttttcaaatataaaagtgtctaagagaatcatatgtgaacaaacaaaaatctctgattccagatttttaggataaagatgagtaacacactggcagctgaagaaagctgaaactctgactaataaatagatccaaattaagaatttctacaacagtttttttttttagaaaacaggaccagaattctttttttttaaatgatgatcctgtggaatgcctttacttccatattcacctaatattgtaacagtaaaacagacacaagaatgttgatgacagctcaacaatgctggattcaggacatttacaggtacacttttgtttaaaagtcctacaagtttattgactaaggctagacagcaattcatatgatcctatttggtgcattttctaccatggtccaagatcattacatggatacagccaaggactgggccccaactttcaggaaaaagaccacaaagaagaaaatcaaggtggctatttggtccccccagttgataatctgtgtcctggaactggaaaaacaaaaggtggaaaatacagactgcaacgagttaaaggacttggaaaaagttggtggaaagtggcacggtatacgagtaaggtcactgggcttgggatggcaagggtgctgcattgaaagagcatccacgggaccaagtacttataatgtctgatggtgtcattccctcaacgacttagaatatctgtatgcgataataaatagatcagttatgtaataaggcagtgtgttgaatatgcattcgtcctgtggaatgaaccaccacagagagatacatgataccatacacattctttgagttttcttgtgttgtgtttgatttgtttgttttcaaggctatccaggctaactcttcccggggatttccttggagagaagagtggtccgctgaggctggtttgctttaacctctcctttatcaagagatgatgactggctttaaagaaaaataaagctgaaggttgtttgatttttattttttcccttttggttgcatcattttgagtgttttcatataaacaacaagaacaaaaaatcacaaccaaaaaaaaaaaaaaccaaaaaaaaaaaacacaatagttcttgatgcatccagttgttatatcctcaggatgttccagatgtttccaggtaactctgtagtttacggactgtggttttgtccagcgagcaaagatcaaaatcaaatgttgtgtttgtgatatgaaagtgtccagtttcttctataaggttcacgatctagaggagtgaagaagagaaagtttgggcaatacgcagcaaacatcaaaaggcaaagagagagtaatggaggggcgatcaaatatggaatcaagtgataaatattcgtatttatagcaacaaggtcccataccatgaatagcattaaactgtctcagtcaacttgataagtcaaaggtatattaagccttagaaattcccagtgagaacctgtcttgcttttcataccctttaaactgatgtctgctttcaagtcatgaacagaatatttaactgtgagtgagcagttagggggagatagcatttcaagactcctttaaaaattagttactgactcaatagacagtgattatacttaatagacataagaaaaatccagccgagaaataacaaaactacttttacttaagtacaaacacatacacacacacacccctatataaaatcattttcctttatcattatataattgttaataatttggaaaatacaggaactcccaaaaaaaaaaaaaaaaaaaaaggaaaagaaagaaactgtctacaatcccacccccttaacagatagtgaccagagggggctcaagggagccttctagagtactggaactgttttgttgtttgacttgggtgctagttacataagatgttgtcacttggtgaaaatgtatctacctgaatgctttgttatactttaacataaaaataaaaacatatttattacttttagttgtgttcacttgattcccctgaatattttggggagattttaaatatttaaggtattcaattaaatagaaatattatctagaaaaagaaaggatgcctttgtcttgtcatttggaatagttatacctcatttcttcttgtattggctccaactttcagaaaaatgttaaatgacagagatgacggttactattactcttgccctggctttcaggagaacacttctgaagtctcaacattaagaatgaaggtgatgattggtttgagagattcttttaccatgtaaagtatcttcccattcctattctactaataattttattggacatggatgctgtatctgggcagtgtattgggcacagcgttttttgggggaggcagcaaagttagtatcagggcaataaaagaaaatttgcacagagtaaacagctgacaaacttctacctgatttgagttgtctgttattctctttctatcacttacctctgattctctttaggtcaataatcttaaaaaagagaataattttaattattgagcctatcatttatttaatgaagttttagattacctaatgccacgctgagtaacagcagaactgaaacttttaaccttctcttcttacaattagctttcttttaaaaaatacagtaaatttgtgaactactccctataggtcagtggctcttaatagaaaatgtgctccccattcctgacatattatttgactttcacagaagcatgacatattaactctcaatccaattaactgctcaactccagattgagctgttattgtcttacccaatctctggaactattttttagggatataactacagccttaatattaaaataagctactctcatagtggatgcaacaacagatgctgcaaactaactccctaatatcgatttattccttaatttttttttattaacggaaggccgtttttctgagagctgcccaactacaatgtttgcctccccagacctacttgcagcacttgtcagatgctgctatttacaatttatttgtcagaactcactgttttcaggaatatttctgaaaagggtatggacaatgggtatgcatcttttgccttctttccttcttcctgtgtgcaatgggaatgcagtgcttggaagtgcagcagctgtcttcccattaagaagacgaatacagcttatgaaagatggaagaaaagaaagacaaggagcctgtgtcatcagtggcatcttttaagccactatctcgaccacggattacttacctccaggcttactgttataggtggggagggagtcagaagaaaaccttacttgcttaaaccactagactcaaggttctgttacatgcatcaagaaattcttagaaggagtgtacccaattatggttaaagtgctacatttatgtaaaaatgtatccaacaagatcttattaacactaaaagatctaaaatggacacacatttgttttattagttattagtaacagaactttcaagaagtcttccacacatatccacacacatacagaaacacaaacacacagctatgcccacagaggcttttcatgtcaatcatatacttactatataattaagatcaattgaactaagactatgtattttctggaataatttttttttgccattttgtgcaaaaatactatgaatctagtgaaaatgtgtaaatttcaggatggaaacaagtagtctctttagagctattataatttcaaatttatgcaatggaggcaaataacaagctgaccagaatttgactcctttcctcagcgagctgcccagtaggtaattgacaaagcattcagaatagagttctggatctggcatatcaagttctgactctgcaaactttttcaatggtattagacagaacatcataacctttgagcctcagtttcctcatctggaaaatgagagtaatgctacctgttctacttgtacaagtttgggcagatgatcaaataaggtatcataaataaagcttcttataaatggtaaattgctacctaagtcaggataacatgattatgattaccttataaactgatccttaattatctgggaggtgactaaactgcacatgaattatagacctgatgctttttcctctcgcccccaatgagtgttagccatttcattagcactaaaataaatgaggcaagaaaatgcagaaactaaaactcagaaaggccggcttgaattaaaaaaaaaaaattgtaactcattcttttaagaaaacagttttccacgacccaatatagttgttccctaattatttaataacaaatagaaaactgggcaataaaaaaatcccttctagaaaaaaagccacttaattttaaagcatataaacacttttgcccactagaaacgtcagcccgggcatttctcatgcattgtgctatcttgcagatctccagtacttccatcaccacccgctacctcctctatcaccatgttgtgcccggcctgcagccacacatgcacaacaatataaaggggatctgataaatctaactaaatgagccccacgtttttatgagagcccacaagaatacatcaaggtagatgcagagaaacagccttaaagtagtagcagtggcagcagctggggagttgggaattatttgccaaagggaatggcattaatgatttgaattattagagcatgtgcccacatcctcatttaagtaagggctccataaagaaaaataagtgtgcattgctttccaggaatcctgatagttagaacgtcagaaacaacattaacatgctttattccattgacacaggccacaaagcctgaacacaccccatgagtgcctgaagaactccactgtgcctttctacaggaataccctctttgctgatgcagtgtggcttgaccttgacgtcattactctgcatcatagtgcaataattaacgtctgtccaaaataataataatagtagatagagtgactgcagataagaaaaacaggcggccgggcgcggtggctcacgcctgtaatcccagcactttgggaggccaaggcgggcggatcacgaggtcaggagatcaagaccaacccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaagaaagaaagaaaaacaggcaaccaggtacatatgggtagtggaaaaggaagagtgtgtaaactgcttaactcattcttcagatgatggttgttgtgaaaacattcatgatggattatttcctgccacatcagcctttcaagcggtactacgcaggctgttggatgtctcattttgttttaaacagggtaagatccacttgtcagatctgtggctcccttccccaatttttaattataaaaaggtaaatgcattgattttggtctgattataatttcaaaaaccagggttctttccatgtgaagcagcctcttcgctgtgtggggagtaatgaacaggccttactttaactgcttctctatggagtagagccagatctgggataacataggtcttcccatagaatggcctctactatggtctggaaagcacggacaaccaccacataaaaatgtgtgccctacccttggttaagggataggccatcaggctccaatctacaaggggtgctgagatatgacaagtaatttcccaggatggagaacatcattttcatcagaacatttctcagggagggttctctgggttcttagaaggaatattctaatacgccacagattccccattccctgcagacaattcgaaaagaatgacggctggcttctaaattgctaaactactctcttaggaaacctggtttcccacagagttttcttcccccagacgtggatgcaaatccaggcttagagctgaattgctggggaggttacatatgttcaatctcactttccaaataaatgtggaacatgtggtttaaagagcaatcaaattattcatcagtcctaggtaatcacttctcttggtttgactgtgtctactctactgtatttataccctttgaaaaagtggcttaggaacacaggctccttgatccaatgctgtctgttcattaaactagctgccgagtgccaggactgcatgcccccagaggaaaacaaagttattaaccgctttttgtgagccaaataaaatcgtcaggccagatttttggataggatgcatttaacaggaaaggacctagatgtgatcctgggcccaccagaaattctgcttcaggtgttcaagtctgcacggcagagaatacgtagactttgtggaatgaattccatgagatgagcagccctcaaggtggagaataacattagtcctcaatagtgctatgttttacaaaaggaattaattaagcagtaaaccgtgacaggacatgcatcatggtatcataatcacaagcctcagctgcattacaaggcaaaaggccaaagactgagagctttcaaccggcctgggaatgcaattagggtgaaatgctgtgtgccctggagtgcctttatgccaggttaaaaattcacagatattactctctccctctagaatactaaaataatccacttggatggagttctccagtaagccacctttcttcgcaattcttataaggtcaaaataaaggacaacattaaattgcgaatgccaatgacaccccaaggtaagatctgcccaatggcctagtatccttgactaactgatagggctttctttgtgaagatgtcccaaccctgcacaaacatctgtcccaccctcctatgagactcactatttgggcccagcttgggcattaatagctttattggacaattgctccacagtggttcagagctggtgtttgggaagagacgagaaagatcatgcaatagatctgcaatcagcattatgccagccccaaatatttggaaaatgacaggtaaaacaacgttcggttcttcaaaagaggcctaagaagaatattagcaaagtactagaccaccactcatggtaggccacttaagtcctgcttccttacccatactaactaaaaagaaactgcaagaaatgcaacttatctgcaattaagaatcataggtctgtagtcttttgttcaaatctaaaattctacaagggttaaaaagcttatcaggccagtcaggaaacttggcaagtttgagagtatatatttatagatgtaagcaaaaatgtacacagaatataaatgtgaccaccagccattaaatgttaaaaaaaaaaaaaaaaacccacacacagctggggtagattaagtactaacgtcaagtcatttgaaagtagtaaaaaaaaaaagaagaaaaaaattcaaacagcgaaacaatctacatgtctgccctggaatttagaacacacattcttctctttgggtgttaaaaaaaattaccaatagctgctggtagtgcaacagaggcatacatcattaactgaatgaaaatgaaaaaccacccttcttatcttctcaaaacatcaaattatactaatagaagtttccccactctacaagtattccactacaagtattccacagttgagttcataataatagaatgtatgtcatacaagataagggaaatgaagaaaatatttattttccttagaatatcattggcaaaggttactaaattgaatcacaaatgtttacaacacttgactcaaattcttatcactgttttcccatgaaaccagaagcctggccccaaagctttttgcatttctactgtcccctccctgagcccacattacaccagccatctgagggatcactacaatccagtatcacttcccaaattgcccagttctcaccatccactgcactagaggagggagaacagttgccatagagctccagagcagacttctaggtggcctcagaaatgagaacctttcccaaatacatctacaggtggcattcgccaggttctgatagcgtggggctgcagtggcctccaggtgctatcacactactgcaggacaaaccaagtcttgaagtttctggaaagggttgtgctaaaaagcatttctcacctgctgcagaatgtgtctttctctcaatgtcattaaccttctgtgaagctctaccagttcatctaggtatgcctgaaagagaagaatgtccccgaaaaggacaagcactttaagtagtagttcaaaaataaatgaatatgtaagtaagaacacacaggcagcagcagctggaggtttctcattacaccactctagcccaggctgtgtgcactcagtgcccaaaggcctctgcagaacaagcctgtcttggaccagtcattacctttatcacaccaacttcaaaaagggagttggagtgaattcttggacttaattgctcttatgaagattcaagtcagtagactcactttcctccaacaatatctctacaaaaggtagggaaattaaatgctaaattgtgagtttaaacatattaacaaaggctactttcatttttttttcattcttgaatctcagaaggtttctaagagaaaaaaattctaagtttgaacatggaaacaagaatgtacattaccaattaagtcaggggaattttgtggggtttttcctgtttgttttgtttttgttttaaaaaggcttcctggtcataccaaacattgctagtaagcaatgccagcaagtgacagaagaacagaagaatgtattacgaaaaacagggatcactatctaattatcatctgatttgtgaagagctcccctgaaaggggagagggggtacctctctttccatatgctcagactcacgagtctttgttagtgtaactgcatgggtgcccccagcaccatttgcgataaaggcaaatgaaagatttgtgaaacattacagaggtctgccctggccctacagagcaaggttagggctctgcccaaaccaggcaacttaaccccaccaggtgttgtagtcaggtttcagaagcatgacgcacactctgggaaagcacactgcactagcatcagatgtcttgctcatctacatctgagattccttaatattctatctctaccacaattctcttaattcccaattcaatgtgcctgaaatcccttggcaacgtaggcatcatggcaaatgacagcataaggccaagcttaatactgaagatataaacaacacatggaaaacaaactacaaagcactgggatgaaatactcatcatttgggcatcttggacactttgatgaagaaaatgaaaggagaaccagcaaggatgatcaagggcaacacaaagaaacggaaggcttgtcagtgttggagccctcctagtaacagactagaaacctaccttgtcacattcaccattctttatttgcttatctgatttgctttgctttattggacttttcacttcaagaatctagggatcaaagagaacgctgtgttaaattttatttcaagcatctcttagctaaccagccacctaaacaaaggcatccactgaatgaaatgtacagtaacatttgctttccaaatagcatttcttttctatacattttccttcttctctctaatcttattttccttggaaaatgaattacttagatctgaaatgctgagtcagaaaagtagaactaaaaaaaaaaaaaaaaaaaaaacaacacagttgatgataaggaaattgatctaagcttccaaggctgcttctcttttgcgacaacactctcaccatatgtatagcagctgagttatacagagattatagttccctctggcaagaatttttttcctattcattctgctgtttcagcatgactactagtgttcagtatgctagggatgataaaaacaaatactcaaatgccctttttagtacctaactttcacattctaaaattactcatatgcacaaaactgatacagctttggaaatgaagatggccgactatcttctgtgttttaagaaatgatgtgtttacccttggtaaaacgccaagtgcttttccttttatctggactgattacaacttaagttatgaatagctttacatactgtatagaagctttggtgggaagctatgtttctacttaataaaaaggagaagcaaattattatttaataaatgcagctgatttctttgacagcatcttcaaaactgaggattaaaagggaagtatttttaaatggtcctcacttgaaaaagcttgaaaccactaaatttataaatgatgagtgcttacacatgtgtataaacacaaaaagcaaagtaatttgtctttttcattataactcattatgaagtgagttgttataactggagactaatattaaaggaggaaaatgccaaataaaggacctaatttatcttaagaggttttatattcctactgttctctttacccattctgtgccctaacttagtaacacttctgtccacaagtttaccacattccgtaacataaagattttaagaatgagtccacttttaatctgtagtggcaagagcactgattaggctcagaagcccaagttcaagtcccagccttattatttaatatttttggaccgcaaaggatgaaatgggagagatgaacaagataagacccagattcccattcagctttaacattttttattactaataaacattttactggatgaggataggaacatgacatcctggaaaagaccgaatactcctgaaggggcatatttttattttaattgagaataatgcacgagtaaaaagtgtccttttaacagtctttcctgacaatcatgctttttttcatcatttttaatatgaagataaccaaatgactaatttgaccaggctaacttaaaatacaatacttttggcaacacaaggaaattacgtattaacagaggcaaggcaatcgtttttaacatgctccactgtaaaggaaaccaaatactccactacattcagaatttcctcctccattgttgttgaaagtgagatctcaagggaaaaatcagcgctgagacctaggagcaagtaggtcagtagatggcactcctcgccaactcagatactgggctgggcatgcagagacaatccgctgagatttcaggcaagaaaaaaagaaaaaaaaagtgcctgcctgcttgacttgtgcattacagaactgaattttgttcccatcatatcccgctgcctcccacgatcccctcctccaactcctgtactctgggtgttgaagtgacttgaggacgctgtatttgcaatagaactttgctaactaggtttagagagttctgccaccttttcttcaaagcagaaaatagaacatttggacgctgaagtcccaccccacacattccgtaagtgctacagcacagaaggccaaaatacattgaaatcctagtttctttcttctgaagttgcagtggcaggaacaaaagctccgggtgtcagtgacccgcctcaagttactgagtggctgcccagagagggctcagttaatcttccttctttgatctctccctgctccaaaataaacagctttgtcaaaacctcattctgagagagctgagccctgctgaagacaattgttttatttatgatcatttcttatctttagggaaacaactccagaataaaaaagtacaacaccttgtcttccacaggcttattttaaaccagtttaactggatagactctttttaatttcattcaacatgccttgcaggctgataggtgatttatgatattctgaatattaacccgggtccaatggatcacttccttccttcaagtcctttctcccctccctccctgccaagcttctggctaaaaaagatgtggtattttgtttttgtttgaaattcacataagggaggtttggagtgaaaaaaccatctctggttgaaatgacgcaacactctttattattacctattaaattgtactgagagaagcagagctacctagactgcctagctactccatttatagatacagcagtctctgaaaatagaagaattgtggtttagtagcacttttgtctttaatctgagaaaatgtcttgacaaacgttcaagattatatttttctgtatcactttatgaagaatgacaactcagttattcacagatggattctctactgatagatctttcatactaatgacagtagctcccaacagtactcaggttaattacttgcttggttgacgtgtgactctatgttcacttttattcagtatgaaaatatttgactccattagtacttcccctcttctctagtccctggaagatttgagaaaaggcaatggacatttcagctttgcctggtgctttatcaaactcagagatcattatcaattcatagagagagaacaggcaaggagtatggaaggaggaaactcaagagtgttcccatttcggagttagtccttccaagtatgttctcaactctttattaatcgtgaaaattcagattcatactctttctctatccctgtctctctccccctacttttctccctccctcctgcgcacacacacacacacacacacacacacacacacattcaaatacgactaaaaagtcattccagagtgaaatttagttgacttttagatttttaagaaatttttactctcttataccatcaacatagagaattaagatatactagtaattttttttaagtcccagaagcttgacttaaagggatagcatcacacctgaccccagtgcaagtgatttgaggggctaggaaaccaatactaaacaaggtttaagaaacctttacttgtcctctcggctccaagacatagctctaagaaggtaagccctcctgtggtatatatatttcctaacccagactagctaaaagtggaagcatacggactttcttaccatgcttacaagtgcatggagaaagtgacacataatacagtattattggcagactgatgattcacatgtgtgaagcaacacttgccaaataaacacgccaaggaaccaggagtatgctacttaatcagataaggtaacttttaccctctccagatagacgatactattcgtttttggttttgttttgctagacaggtaaaaaacagtctgacaaagagtctaaacctttccctaaagccaaggtctgttcaagactgcccattcaggaagggcttaagtgaagccataaggtttgaagggcatgaaaggtgcttgctggagttgcattccctagcaagcccacttttcactatgattgggagagatactgaaggagatgagtgaggggcacaaaagcagagcctaatgccctacactcctggccctgccactgctgtgcccatgacgtattgtagctctcatataccacccactggatacagaaatcaagctgaaatatgcctaggttggatttaaaaatatcatcggctgggagcggtggctcatgcctgtaatcccagcactttgtgaggcgcatgatgaggtcaagagatcgagaccatcctggccaacatggtgaaaccccgtctctactaaaaatacaaaaattagctgggcgtggtggcatgcacctgtagtcccagctactcgcggggctgaggcaggagaatcgcttgaacccaggaggcggaggttgcagtgagccaagatcgcgccattgcactccagcctgggcaacaagagcaaaactccatctcaaaaaaaaaaaaaaaaaaaaaaaaaaaaaatctcaccaaggttcaaattctattctaatgctagttctcactgaagcacaaatttacaaaaggatcccaaattttctagttaaccagtccagtgttctcagctgattggccatgatgcatatgtctttcctctttttactttcctctgaaatgcctgacttgtggtggcaggcatccacaccagaggtaaaagacggctgggccatgagcacagctggccctgaagatggggaagagccaggatatggaaaaagaagtaaataacttgctgaataccccatctataagagataatgaggctggactttgattttaatgtaggacacaaagaaattgcagttgaactgtaactggtacaacaaagagtactggtatcattcctacttaacaagaacggatttgcattatagacaaaccttataaatgaggaattttaaactataagagatctttgctagtgctttaaataaaatgcaaaaagaaaaagtcttcagctctaaactaacattttccaagtaacacaaagaccacggatttaagggcaagactatttaaaattgaaggacacctgtgaaacagtattttcagaaaaacacagttgtttagttttcaagttaatattcgtacagtaacttgaattaagcagttattgtagaggtcataggaaatctgtcgacacaaaaagataagaaaaacttatggtaatgagagtatcaattcaatgctcaatgaggcttttacattattcatgatactgaaaatagtttattttagttggtaaagaaaatatcccgatttaatttatttaacaaatgctctttatcatagccttcaaagttctgcctagatcttatccaaatagttatattttgagttgactatcaaattaataagctttcctttagctcaagttgtaacaatgataatgaccattattttctcagcattttattaattattccttaaaatcccaagtaataatccttctatcttggacgagaaaactgaggccgaacacctataataataaactaccatcaactgagtgccaaggaggggctgtgcactgccttttgctctttacatatattatttgtcatcttcccaataacctaaaagatagtgttaatgtcatttacagataaggaaactgagaatcaaaagctaaaagttaatttcccaccagtaaattaccagtggtaaagaaccaagctctatactaggcccaaaggtcatattcttcctaattaaggcacctacttactgctgaagtgtaaagtatatagaaatcaggagtaaatggtaaatgggcaatactttttgtcaccctctcttattgtactaacttaattaacccatctggtggaacatattcatcttctcatgacagcagaacctcttataccctaactatgtgtttattccacaggctgtggcctccctcccatctatttggcatcaagaggaagtttgtttaaaattcagggatgaaagttttgcatgctttgtaaaaatgattacacctagctctgcagagtcttgcaaagtgcaaaccccacaatttacctggttgttgttggtttttagtaagggtggtggaggttcgtgatgtaggggtgaagaagcagaactgctttcactatcgctgccatcacttaagctaactctgaaaagaaacagacaagttatgcacatcattacaaacagatgattcttgaaatacccatagaaataggcgtggaaagcacagaatccaaacactaacccttgacaagttcattttaactcacagccgctaacacatattggtgcttactttgtaactggaactgtgttaagtgctttacctgccatttctcttttcatgatctcctgtttcacagacgagtaaactgagactcagaaagactgggtcactcatctagggtcacacaggtaaaaatggtggctctggaattcaaatacaagcaagtggcccaaagctagtgctcagccactatactttactggggtcatttattcattcatctcccttctcctgctctccctacctactatgatcaagcatgctactcaagcttacagaaggtcagcaaaattagtttgttgattactacctttattttcctttcctcctccctctctgttacagatgaaaaagttacaaacatgtctagaatacacgctgcaggggaagaagcaaccacataaatgaaacttcataaagaatgtagaaaacagccctgcaccgctgacagcacagagtgacatctaaggattgaacatgtggagcccggcatgctaggaccattaccaatcatttctactgtgtcattattcaaggctgtctctagttctgaacactgatacaacaattcattggaaatacgctacaacaacacaaagaaatggtatgtttgggataaccgctttggaaaactacaatgatatattttaaaaattaaagaactaaagacaatccacaccacctcctccccattttttcttttcagaagaaaatggaattttcttttatccacaataggagagatttatttattctactgtgctgaatgtagtcctccctcagagatgtcctctttccgtatttgctcccctcctctctggttatatagcacctaatgtaatatgcttctcagaaacagaaactgttttagaaatcaggatagtttttctttcactctgaataggcaatcacattctagctctataatgtattcagacagacaagatacaagataggaaatgaaaaggatacactgggacatccttttagcaaaaactgatagaacttgtttttcttaactaaattacattaatgaagtgttcagttgaagtgctgttttaaaatgtgtcttgagtgaagtggaaggctaagtatttaaactgattaaacagttgagacttcacaagtgcagtgaagatcaaatgttacactggcactgacatgctaacacagcacggtcaggcagggaacaagaaaagcagcccccaaaatgtgtatctgtatcagatgactcacaaacctacatgatgaccacacagactcaggagttgcagcaataagtaggtgggcaacaactaatcacagaatatccagatattctaaataacaactagggaaatcatctaaataggtcatacgtttttcatcaactaaacttgagagcagccagtggtcaggattttggttggtataagtaagctactttaagtttcagtccattttgaggtcttttttccctatcagtttcctttttatcagacaaaagacttctaaagggaaatgttataaggccatgggcatattaaagaggttatattctcctatttaaaaggaatgctgacaggttggtctgagagacaaggagagaaacaggggttgaatatgaccataaaaaacagtcactgagatatctaatggggcacacaccctgaggaggctcttttcagaggacaaagcattggcaattaggaagcatcggtctctccagtttgggttaagaccgcttttttttttttttttttttttgaatcttagggtcttctacatagtaatggataacagggaaagatttaatgcaatatattataaatgtaattggattttaaattcaagtagattcgtattttttccactcaagacaaattaaagtaagcatgcctatttgttttcttcatgataaagaaataaaatcctcagggcaatttcaagttgagtattaattataagtgacatgaattaccatcttataacatggaattatgcctcacagcattaaagctacttaaggcacttaattgtcagcacacttaaaaggaatttattttctggaaaacacacaggtgatcctagttttaattaggtcacacacataattcactggagccaattatgtatttctaactacaaacagcaaacacatttcttcaaattctgagactatctccagcagtggatcaacacaaactcttcaaatgaaaacagactttagttcaacagtcagtcctgccacttggcatacttttccaaggacaaggacatctaatgtgactttttcctataaaaatttttagaggaaaagcctctttctgagaaaaaggagaaacagttccctgtaaagtgtgtgtaggcataccaaggagaccctgcatcaaatgaatgtgaccatctactgccgtttttggtgtttcacacctttgctgtgattatcccagcagggcttgtgaaagagtctgacttcatcacaggcaacccctttccttccaagatactcacctgcgacttcggctgcctcctctatttacaggcctctccatttcagagtcattgtcgttatcctccacttcatctgattcctcctcattgtcatcagaatgcagatctttcattatagacctcaaaggacctgagtaatgacaatgaaccacaggcaatcaaacatatactcaaacacacttagccatattagaaacagggggatgcttaccagcactgaacactggttaaaaataatcatcatatatatttatacaatttacaaggcaaatttggtatagtttctaaaatgcaatctctgccaaaacactattgttttcataatggattcccaaaatatttattaaagaatctctattttctaggaattttttttctgtgtatttttcttccctaagaaaaattatacataaaaagaaaaagaaaaatctatcagtaaattgaatgttttgttaggttaatccatgtattgagaagttgagattaataaatcactgtggttgtaacttgttcttggcaatgcagcctttgtgtggtactttttgatccattaaggtttagctgttccttttatttcaaggtcaatttcaggtcaagcaagcatttcagtcaagttcagattataaagtatttcaattccatggtgtaatatcctacctctgatcttcacattgatcttggacacaaggtcttgttgcagcaattttaagcagccaattttcattttactttttaagaaattactggcacaataccagcatgtataaacataaacaagaccatgtaataaatcaggtacacagaaaaatcaggacagtatccagtatcagacaggaaaaagaaaaaaaatcaaactctaattttattctaggacaggacagaaatgaaaacacacacacaaacacaaattcatcagtgtggcttattttcactttactaggctaaatgtgatgaaaaatagatagttttaatcttaacagaagaggttataaagacaatgaagaaagagagacactttcattcgggattaggcaattcctaaagtcccatctatgacagggatatctgagctattactatcttgactccctacaatctcacattctgcaaaacccaaatttatctgcttttgtagtgggcttatttctttggaagtcagtgaaacaagacctctgaatagccaaaacgattactgtcttttattttatttttttcctggaagcttagccttagtccaaacacatacaacaatttaatccttttcaaaacattcaaagccatcaggaattcagtgtggtcattgaaaaaggtaatgttcaatactatgctaaaacacaaattctactttgatacctatgcatttttcatgtaaaaagagtgtatatttgaagattttccacatacacaaaaatggaaaatataattagttaaatattctagtttaaatgtctttattctgaattcaagttaacacttgatcatgagtagagaaaaatatatatttaaaagatagccaattagtattgccttaaagactattaacatgtagaaaaaaaatatgtccaggaggaaagatgaaaacctatttccctatgtcaaagcctcttaaagcttttgctattgtatttcctttgggaactccctgggatgggctgtgtctataatccttttgtagcaatgacaatctgatggcagggaccggaaaaaggggaatttctagagccttgcctcgtacatcagaacaatactcaactgtattcctaagggaaataaatacaactgcataaaagccaagttatgattcgaataataaaacagtataaggtgataaatcaagacattaagatggtttttttttgttttgttttgttttcttttttttgagacggagtctcactgtgtcacccaggctggagtgcagtggcgcgatctcagctcactgcaacttccgccccaggtccaaaggattctcctgtctcagccccccgagcagctgggactacaggcgcatgccaccacgcctggctaattttttgtatttttagtagagacgtttactaaacacggtttcaccgtgttagctaggatggtcttgatctcctgacctcttgatccacccgtgtcagcctcccaaagtgccattaaggtgttttatgagaaaagcatctcctagtttgcatgagatgttgataccttgttgcctggtctgggatggtgtgaagctggagctggagctggagctggagctggcaggactgggttgttcagactttaaagaagaataaaaaggcaccatcaataaatttacgggataccacacatctaaagttgaaaacagtattgttgctcaaaccatcctctgcaaaaaccgtgatgcatttcattatgtcaaattactaacacaggagagtcatgttgtcttttgttgtgcccactgtatttttattagatgcagaaacaagtataaaaacttgaggagataaacacttgggtgttacatgagaaaagggcctggctttgatttcactcctacgtttactgctatacaggtctccctcttttcatcttagatataaaatacttctttattatactttaagttttgggatacatgggcagaacatgcaggtgtgttacataggtatacatgtgccacggtggtttactgcacccatcaacccatcatctacgttaggtatttctcctagtgctatccctcccctagcccctgacccctgaaaggccttggtgtgttatgttcccctccctgtgtctatgtgttcttattgttcaactcttcacttatgagaacatgcggtgtttggttttctgttcctgtgttagtttgctgagaatgatggtttccagcttcatccatgtccctgcaaaggacatgaactcatcctttttatggctgcatagtatttcatggtgtacatgtgccacatgttctttatccagtctatcactgatgggcatttgggttggttccaagtctttgctattgtgaatagtgccacaataaacatacgtgtgcatgtgtctttatagtagaatgatttataatcctttgggtatataccccataatgtgattgctgggtcaaatggtatttctggttctagatccttgagaaatcccacactgtcttccacaatggttgaactaatttacactcccaccaacagtgtaaaagtgttcctatttctccacatcctctccagcatctgttgtttcctgactttttaatgatcgccattctaactggtgtgagaggatatctcattgtggttttgatttgcatttcaaaagaagacatttatgcggccaacaaacatatgaaaaaaagctcatcattactggtcattagagaaatacagctgtctttctaagagataccttgattaccctttctgtaatgttcgattgactcaactggttaaaacatagtggtaatgaggctaaggtcattagttcaatcacactatgagccagttaatttaactgtggcccaaggccatgacccaaccctaacccttttcatccacagttcacaaatggaggccaatattcataacaagacccagacaggtccaaatgagtcaagggaaaatgtcgccattgtttttttgtaaattctctttaattccacaacctattagtggcaaggaaagagtgtcatacacacaccccaatctcttacgctctatgaattctccttatccttttctaaccagaaagttccacatcctctttgacccacccaactcagttctcttccttctccaaaaccactgaaatatagtggaagtatcatgttttcttgttagaggtacaacagtattgcactgcctctgatgtgtctttgctccccagatagtctgtagactgccagcacttgaaaaattaggggtctgtcttgtgcttcttgtaatcctcttgtacttagcataatgcattgtatacaagaggcactttttatcggtgactaaagacggtacattaggccctgcgttccaccttctgccacagtttttttgaaagattccatggcaggtaaagacaggcaatgcacacacatggacctaagtgtgcaaatataccaatcataccaacaaacttgaattttacatatttaaggctaaatttatttcacaataacttagtcatgttctcataaccaaatttatttccatcctatttttaatatgctcatagtcttaactatatatttgagaatatttgtggtttcctgtgtatagaacaaatctttttaattcaaggtgaccaaatttgaggacaaactaagagcacaaccagaaatcactaaatgaggatgagaatctcagtcagtttatatttgtttctcaccaatgctttgttcatctccctttccagcactgaattctcacccccttctcccaaggtagcaccaggctctaccaacttggacacaaggaaacactttattcctaatgcacaattcacatcctcaggcttgatgggaaagcaggtgccagcaatctagcactcattctgcaggaaaagagccagacaggatctctaatgagcagcaggcggcctaccaacccttcagcactgtaacatttacttgagtactgtagcacaatgtcttacacattgctgtttgtgggtcacaaagaaaagttggtttacacgtacaaatgctctataaggtactcttcatttctgttgagtggctcttctactgttgagccccaatggcgagttacacaactgaaagagcattcagttggcatttatgtgcactgcccagctgtaaaacatttctcccagggtttgcagagtactcctcttcctctccaagttgctcttttcagccatgaaaagtgcctgcaaatgatattattttgatagctctggaaaccatctgggagccgaaaaggaggtttccttacagtgagcagagagagctctaattcctcatcttgcctggccagttcacattgtattggacttaaaggagccactctgccagagctatttgctgagaatgatattagcaaggatgacaagagaagatggtggtcatctctccaactaccccacatgaaacattactcatttgtctcaagcatcatgtcaatctcagaaccaaaccaggaggcaggcttcttttagcttcttacccataaataaggttaataattccacagttgctgatcaccaaaaaacccacaaataggaacataacacaacaggaaaaagggctttttattcatcatttatgattaagaccttgcctctgccacaaagtatttgagaagttttacaacaaaagacattaattctacaaggacattaaagtagaaagtttaaagcaaaagagctggataaaaaaggataaaatgctgaagagtgggcaacaaggcaatgtcctgaaagcttttagtagtcaggacagaacaagcatttgtggaagatgagacctttaaaatgatctaaggcagtgaatctcacactttggtggacaacagaatgacaggaggacttgttaaaacacagcctacagccccacccaggagttacagattcagtaggttgagggacatgggtgagtgggacaggaccctggaatttataaagcatcacaggtaatgatgatgctgcaggtccagggaccaaccatgctgatgagaaccactgatcgaggacccagagaccgataatcacagaaactcaacagaattagctgggagaagcctatatatgaggagattctgatttaataggttgatagtggagatccaggcatttttataaaaagctcacaagagatactggtgaaaactacaggatgaggccactgattctatattagtctgcctttcttccttaaacacacacacaaaaacacatttttgaaagaattttaaatttaagaaagcatgactatatatatcatgagaaaaattagaaaaaaattgacttatccagaggcagcttgaaagaacgcaattgccacttaatgaaaacatttatgaagcatgtacaaccatgttgtgggggagacaccttaaactaacttaatctgcctagtacagaattcacctgttaactgctcaaagagccactctgccactagaggaggctgacactgtcttacatttcatcaagcccaaccaacagaattgcagttcactgtgagttatgtattttatttttaaaatgtcacatttatcttccaaaaacaaaccaaggatgattatataaactaaagaaggtcacttgctctacacacacaaaaaaatcatcatcaacagggttatatgaagatctttatatgaagatctttacaggccctaaggattgcaagatataataatctcctttccccaccctaccccctaagaaacattttaaatatgtgcttgtgtctgtatacatgtagggcgtgcacatgtgtgaatgctaaaccaaaaattcagagaagtccaatgaggttctgattttttccccttcttaatataacacctgtttgtaaaatatcaaaattctcaccaccaaaaaaatgttttactacttcttgctgatcctctaaccacatgcttacctgacctactgggtaatgaaatgctatgcatgtagtttctttcaatggtatgttctacagtgataaaagtatagacatcctttgcttcatcatgccatttttccaacaatttgtgttcacttcatgtctctgcatcacatattggaaatccttgcaacatttcaaactttttcattattattatacctgttatggtgatctgagatcagtgatctttgatgctactattgtaattgctttggggacaccacaaaccgcacccatgtaagatagcaaacttaatcaatgttgtgtatctctaactgctccaccaacctgtcaatcaccaactcccttcttctccttgggtctccctattccctgagatacaacaatactgaaattaggccaattaataatcctacaatggcctctaaatgttcaaatgaaaggaagagccacaaatctttttttttttgagacagagtttcgctcttgttgcctaggctgcagtacaatggcaggatctcagctcactgcaacctctgccttccgggttcaagccattctcctgcctcagcctcccgagtagctgggattacaggtgtgcaccaacacgcctagctaatttgtatatttttggtagagatggggtttcgccatgttagccaggctgatctcgaactcttgacctcaggtgatccacctgccttggcctcccaaactgctgggattacaagtgtgagccactgcaccaagacacatctctcactttaaatcaaagctataaatgattaggcttagtgagaaaggcatgtcaagaggtgacaggccaaatgctaggcctcttgcaccaaatatttagccaagttgtgaatgcaaaggaaaagttcttgaatggaattaaaagtgctactccagtgaactcatgaatgataaggaagcaaaacagccttattgctgatatggagaaagttgtagtggtctggatataagatcacaccagccacaacacttccttaaaccaaagcctaatcaagagcaaagccctaattctctttaattttataaaatctgagagatgaggaagctgcagacaaaaagtttgatgctagcagaggttggttcataaggtttagggaaataagccatctctgtaacataaaagtgcaagttgaagcagcaagagctgatacagaagctgcaggaagttatccagaagatctagctaacaacattgatgaaggtggctacactacacaaattttctatgtagacgaaacagccttctactggaacaagatgccatctagagctttcatagctagagagaagtcaaggcctggcttcaaagtttcaaaggataggctgacactctttttagaggctaatgcaactggtgaatttaagttgaagctaatgctcatttagtattctgaaaatatcctagggcccttaagaattatgctaaatctactttgcctgcgctataggaatggaacaacaaaacctggatgacagcacatctgcctacagcatggtttactgaatagtttgagcccactgttgagacctactactcacaataaaagatccgtttcaaaatattattgctcattgacaatgtacctggtcacctgaaagctctgcaggagatgcacaaggagattaatgttgttttcatgcctgctaatacatctattctgtagctcatgaatcaagaagtagttttggctttcaagttttattatttaagaaatacattttgtaaggctataggtgccatagatagtgattcctctgatatatctgagcaaagtaaataaaaaaccttctggaaaaggattcaccattctagatgccattatgaacattcatgattcacaagagaagatcaaaatatgaacattaaaaggagtttggaaaaagctgatttcaaccttcatggatgacttcgaggggttcaagactttagtggaggaagtcactgcagatgtggtggaaacagcaagataactagaattagaagtggagtctgaagatgtgactgaatttttgcaatctcataaaatttgaatggatgaggagttgctgcttatggatgagcaaagaaactggtttcttcagatggaatctactcctggtgaaaatgctaggaacattgttgaaacgacaataaagaatttagaatattatataaatttagtcgataaagcagtggcagggtttgaaagaattgagtccaattctaaaagatctactgcactatcaaacaacctcacatgctacagataaatcttttgcaaaagtcagtcagtccatgcagcaaactgcattgtcttattttctttctttcttttctcttttagacggagtctcactctgtcacaaaggctggagtgcagtggcaccatctcggctcactgcaagttcgttcacgccattctcctgcctcagcctcctgagtagctgggactacaggcacccgccaccacgcccggctaatttttttttttttttttttttttttttgtatttttagtagagacggggtttcactgtgttagccaggatggtctcgatctcctgacctcgtgatccacccgccttggcctcccaaagtgctgggattacaggcatgagccaccacgcctggcctgcattgtcttattttcaaaaattgccacagccactcatatcttcagcactccaatcgataagtagtcatcagcatctgggcgagaacttctaccagcaaaaagactatgactagctgaaggccaagaaaattgtaagcatttctggcaacaaggtatattttaataaggtaatatatactgtcacacttaatagattaccatatagcataaatataacttttatatgcactgggaaaccaaaaacttcacatgcctaattttattgtgctatttgctttattacaattgtctggaacctaacctgcagtgtctcgaaggtatgcctacatatgctgaagtatcttaattctactgcttgatagtatattttggtgaagattgcttaaacattagtttgctcatagagtgagggcactgaacctcatacagaagtgattaccttaaattgatataataaagtaaaaacacctagcacactgctgttctaatggcagctaatcaacatttgattgctactatcatttacaataggtcacatactcctctactgcctaatacaagatatatctttactaccaaaacaatgggcctaccaggatttgcaatacaatcttcaacattaaatggctatgcaaaatcattttgtaatggattttctacagagtattacttttgtccaagacaagtaagaaaaaccacatgtttacaactagaagtgtttcaaaagcgagcacctgtcaaggtagatcacaggggaggcctgcataagctggcactgatcctgtactaagagcatacttcctctttaggtaacagatgtcaaaagtagttctgtcttttctaattggcaactatatttatgaacagaattttggtgacttgatctttaaagcaatcaaaataaaaatagtgaaaagggaaagagtacagtataactagttaaacagaaatgatttcagacacattgctacacttttcataaaatgtaacctcattagttacattacgaaaatgtaacttttcataaaatgtaaacctcacctagaaaaagaacacctagagcctgctataaagattatctcttctttcacaaatatccagaaagactgtggatgaatactaatgaaagaagaaaacacaaatataggacactttatttacttctctgttcaattttcattatgcctgactgaagtattaggttcttctcacagttttggtccttctttcattaaaaaaaaaaatcaccttacacattatatagcttttctttttgcttaacataaaaaaaaaaaccacttaaaagtccacctcatttagtttctcctctgtaggaaactgaaaataatccactcaatttttaaatgtacatttaaaaaaataacataacaagctaggtgcagcggcacatgcctgtaatcccagcactttgggaggccaaggcaggaagattgtttgaagccaggagttcaagaccagcctgggcaacacagtgagatccccatctctacaaaaaataaaaatattagccaggcttggtgaagtgtccctgtagtcccaactacttgggaggctgaggcaggaggatcccctgagcccaggagtttgaggctgcagtgagctacggctatgccactgcactccagtttgggtgacaagacaagtctctgtctcaaaataaaatacataacatccatgccaaacaattgtggaaaaatgctttccattagatgagtgaaatctatgttaccaattcccattaatgggtaaaatattgagatagctatgccaataaaaggtaaggccaaatttaaacaaagaagtattgaaaagtgataaaacaatattctacttatgttaacctaacaatctatgcactagcgaattattaaaagccagaatcaagagaaattttattatcatttggttttacattagtaactgcttcaaaaacatgctaaaagaacaaaactttgttatataaaaagatatataaaaatgagattgaacaaacatcagtaactctaacctcataatgtatttttgtgtagctctatcatattccttatttcatttgcactaccactagtaaggtgagtgataggaattatgccccctctaccctaaaattcacatgttgaagccttaacccccagtgtcccaatacgatagtatttgaagatgggacctttgcaaggtaattaggtttaaaatgaggtcatgaacgtagggccctcttgatggaattggtatccttgtaagaacagacaccaaagagcttgcttcttttctttcttactatgtgaggacacagcaagaacgcagccatctgcaagccaggaagagagaccttaccagattccttgttggacttcccagcctttaaaactgcgagaaataaattgctgttgcttaagacactcagtctactgtattttgttatggcagcccaagctgactaagatagcagggtgcattttagatcaatatttttcagatgataaaactgaagcacacagtaagattaagtgaccgggggtaatatttaggtgaattagaaccggattttctgacttctaatccaatgctatttgtactgcaactattaactttgaaaaagggcaattaatttaaagcagtgttctgaacatactaacacccttttataaattagggacagggaagaaagttttgtcactgcagaagatgtaaggaatatcctttgtccccaaggtacatcttctgatccacacccaaagcaaaccagtggtaaaacaaaacacttcatcccagcggagttaatgtgtctgatccattgcttctaacatttgtccaatcaatattacaatgaatcctggctaggaaccttgttatttcagtaatttttttttttttcttttctttttttttttttttgagacagagtcttgctctgtcacccaggctggagtgcagtggcgcggttctcagctcactgaaagctccgcctcctgggttcacgccattctcccgcctcagcctcctgagtagctgggaccacaggcacctgccaccacgcccggctaggtttttgtatttttagtagagacggggtttcacagtgttagccaggatggtctccatctcctgacctcgtgatccgcccgcctcagcctcccaaagtgctgggattacaggcctgagccaccgcgcccggacttcagtaagttttataaaggaaaacagggaagtttcttctctgaactgccctaatcctcttgagactggcattaataggaccaatgagcacatcaggcaacacagtaaaatcatatattttatttaccttcaagtgatctacgttcttttcctaactcttcaatataaatcccataatatccaagaaaaaaataccatttaatgctttaaataagctgttaacagctctttctttcaaaacaaggtggaaccggggaaaggacactagagtgcaacctttattgctagacacctactcaagtctgtaaccacagagaagactctacatctctttttagtagatgctctccatttgtattacgacaacttgaatgaatttgatgttagattagaatcatatttagcctcttgagttcttatgttatcaaaagctattgttatacccatcattttctgatgatagagcaagatcctgagaattaccctctcaactgttagcaaaacaggaaacgtccttatttctgttatattttcaacttacagatataaaatcatcctggaagccaagataattggcttgcattgaggtgcctgtttttacaattacattcactttcttcattattatcattacctttactattattattaaatgctgtcatttggacttatcactacttgtctgagaatagaaaatgtcattaggaaataaaatggcctcggggagcaggggtctataaatctctccataagacccttttccacacttagggatggctatcattttctttcagcttcctcccttttaagcagaagagcctcaagtcttttatctctcatcaccatttgtactttaaaggctgctacgattgtagccagaacatgtgctctttcaaaaaatccagttgttgcaagatgtgttctaagatcactggctgaaggatccttgttaagagctttgagaatgagaaatcatctgaaaacagaccacttacagtcacaccacctataaacacagtactatttttgagcaaagttcacatgtacagaagttgaatttcacaactgacctttaactacaccacttagttgtgatgccaaagacatatgttttagctgtgttttctctttctcttttgtgtgttttgagagtgacgggtagagaaagaaaaatgttacaagtgagagggctcagagctgtaattcctcacagaagagaaacaggaaggaaaaaaagtttcctgatagaactggcccataattaagtgttattggagttgaccaatgaacatcgaaacaccactacttgtcagtttacaatgagatcttgagattattgtcagaactattcagttacttgtgaagtaaccctcctgtgcagagcataagaaatttaaaatagtggaaaatcacttttgtcttctcaacatttataacggcaacattgaactgaacactgaattgaacaaagtcataaaaagtacattatggctacagggctcagtactggattataaatattaaagtatatttgggattataaaaaagtataaagtaaattaaatagaatgaattcaggaaataaaggtgataatgaaatgaaataactaaaagatatatatctgaagagattattttgacaagacatttaactacatttccttattaactttaaccttttaaaaaatgtgtcactttaaaatgttcataaagcatttgattgacaccaatataatctttacagatttacacagatgtcaagaagtattaattttaatctttggactatcttacagaattttcccgattaaatgtgaaacctggatttactatcatggcagtggcattaagagtttattttatttgctaagaacttatgtccatggtagtttgacttttaatataaccaaaatccactggggaaaaagtgttgacttaagactacctcatcttcaccaggtcaaaaatgcaacattttctcattatcagcttatgaaacaaggactactgatagttgcaagggttatttctctacaagccttatatcttcctcaatagaattagaatactggagctctttcctctatctagatcaaggaactccaaagttctttgggtgtgggtatgaatgtatatgtttacatagatgtgtgtaagataatacatagtagtaaaagaaaataacaagacctcttttcatattagtcttttacttttaaattttcaattttttgtatgtgttttcttgtacataatatgaaagtacagcataacttattcttgtacataatatgttggcttactataatttggaaatgtacatacattggggatacaggtttacagggagagatgagttgtaataccaactctgtaagttttaattctgtaatttacctgctcaaatcttaattatatcacatgatttcaagctctggagtgatacatgctaaataaacaggacagtctcattataactcacacagagagcatccagatttttgtcattttacagtattttataacaatcaaactcagagcttaaaagtttactttttatatttatactgtacacagagttccttattgaagaagaggtaacacaaacttatttaaaagattttgaagtgcacatagcttttcttaaaaacccaacacaaaatactttacataatccccctagaagtttgaaattatctgtggctctattttagagtttgcttttatagtgtttacagaaaattatacaatattaagtgaaattgtttataatcagtctaaatgtgctatacttacattcacttctatttaaaatgttaagtcctaataaaaagtttgtaaaaatatatctattttaagaagtccctctatcttagtgaaaatgaactaaagtagcaaaaacatgctacatttacaagacagccctcatgtgaaaacttaggaggtagattcttctgttgtgttctcaatgtagcccctttaaaaatgtggtattcagaatcacatattcctgattagtaatattagatttctgtccagaataggaggaatgctgctgcttataaggctctaaaggaacctgcatttccatgcacacatcttatataagcctaacagttgcttttcttcataaatcaatctattgttgcacttcataatgagaaggcagatttactgccttttaccgccttttctcaccatcagaaagatgcctatttgggtaacagaacgtttctcttcttcaagggtatttgggattagggaggcaggggcaagaacctttaacatctgctcccttgaaatgaatgacacctctagttctcacagcctggacgttgaaaagcaaatactctaacttgataaaattctctaacttgaagaagcacaacactttaaatacactgaagtcccatctctaaaacatacatttgggatttagaggttataccacaaaactaaagaacacagaatttagattgtcccccaaaagcccccaaatcatcatcatagtgagaacaattggaatttagaataaagacactggattcatcatcttgaattttctctagccctaaaaacaaatctaaattactggctagtaagactttaatcatttgagtctcaatattgtgcaggaataacaaaacagtttgcaatatagacttaacattcctctgtttttatttacttaatttttccccttagggagaaatatttaagaattacaaactttaggttttaatttaaaaacaataagaaggtacttttcagcatctaattcctaaccatctgccttttaaaaatatacacacacacatactcacccattcactccagttaggcttaacattcttaacaagtaagtagatcttgatggatctaaacagaagtttcagtaatcagagtcccacttttggaaacaaagctatctttaaacaggcaccatgactcctactagcaaaagcagttaaccataaacttaaaacaaatagacaccatccaaaacaaataaataaatgaagtgaggcaggtactggattcaagaagaatctctatttttgaagaaaactaaattacatctcctcgttcatgaatatgtagtattgcccagtgagctaacattcttgttacttcaggctatcttttgtcacttaagcaatggtttttgacagttttacaggctgttatcccaaagacttcagtatttacggcctttattcacttgggctttctactcttatccactggttactaatcactaaacagattttttttaaaatgggactgaaattagctcacaggatgtccttcaacaatggcagctcaggacagcaccggtaaaggtcttctcctcagcctcttcctctctctcttcaattttctcttcctacagacaagttagtgagggtccagatccacactgttcaattagaacaacagcacacatgatttacagcattcttaggggatggttagggatcgtttctgaattgatcctcagaaactcattcaatttcaaatatctcaagaatgatttaaaggcctaacttgtttttaatcttcataaaacaggagcaattcctacttgtggaatcattattcaggaattattattcagttctacaaaccttactatccacacacaattgcacgtacaattcaaatatggatgcttttaaaacttcaacacatttagttgtaacctgccattccaatttcttcctatgtagtaaaggctgcttattaccttttatccactacacttaaacaccatagaccgaaaagcaaggagaaaacacagaccgttcttttcacttaatttcatctgacttaaacatctcctaagagattggtttttatcttaggaacaatgtgaaatgcgtaacagagtacattctcttttctagctggctgctggaaacttgaaagtcaaattagactggaaagtgctgttttcttataaactaaaaatgcgaaagaaagccagaaatactgatgttattagtctcatgatcttcctgatgaactgagcaaactgcagaattctctgagaatgggctgagcaatggcaggaggaaggggagagactagctttaaagaaacactaaggctccacttattgctctaaaatataatatactaaatatgactcttcctagaataaaaggaacttattatgatcagcttctgttttctctgaaattgtgctgaaatgaaatctcaaaagaaaatgctccaacaaagtattttaaacctttagatatttccacatttgggtagaagcaacatgttttagtgcatcagaaaaacaattttatcgggattagcattcatatacaacatttacatataatattaactatttggacatcatgtgattgcatttaatttatagacatccacatgacaaattctccttgaatgtagttccaggaaaatttatttctgctgaagaatgtgcacgctttccgatattccaaatataaaactccataactgttatatttctctaggaagaaaatggcagaacttattgcctatgtgtaaaaaagcacctaactctgaacaaatgctgtgttctttaaattttgtaactacttatattagattatatttgccatgtatattaacctgtaaaccaatctaaatgccattcagtcatataactattaaacaagttaaaaatgaaatacatgtacttgcatgagaatttacatagttatatttttaatttaataaaacaacattttaatgtataattaagggctaatttttaccaaataccctagtggttagataacaagggatactctgttatttttctggtaagttaaatcttgcagtgtttacttttatatttaaaaatatgtgaatggagaaaatcattttggatgaacgactttcaatgtatgataagctatataattaagaaaaatgtaagaacaatattattctgaaagaagattcatttcagattagtaaaataattagaggtctaatccttagcttctctcagaaaataagagaaattatttaatacgataatcatgagttaaaaaatgcttctatttctttaacatgcacttaaaaattcactggtagataaaatacttgtaaatgtgctgaagtcagaggagaagggtatcttttttcctactttaaatcactctggagaacaaatgcacactggggctcctattttaaaactttttctctatttttttcttaattagatgaatgcatgttatatgcacattaatcatctaaaattgtaagattttcctgaatttttctatacatcaaaacctcctgtggcttttccttgttccatccctctcaccccatttttcattaccttacataatatcccagaagctatcttgcctatgaaattactactcatagtaaataaactttacatatagtttatctttaaaaattagaaacacagcaagcaaagaaattgttctcacctctttcaaaagaaaacggtgtagccctcaggaaaacagaagtgcccctaagttcatgtgtgtcagcaaggaatggagagctgttaagaatgatcttcttgaaaagaaagaagtctccttaggcacccacatgtatatttagattagactggcagtttaaatgacagcaaacacatggtcatgacttcccaattgctcattcatctaacacatacacaggctaatcagaggcaaacatccaccccgaactgttttagaaactagcttctcccatctgatactactgtatgtgtggtaagcagacattcttctagagagatcggatgtcaaatgcttaactacctctcttagtataacaggatcttaaatcacactgatttagaattccagaatgtttttgtaaagtcagtttgacatcaacttacatcaattccttgctctagcctgcagggttttatgaagtacaaagtaaagaaatgactatgtaaagattgcaggatctatttgtcttatgggtatttttaaactgtaagacctgcccatcctatcagtaatagcacacactcctattctgtaaacagggtaaagtcactatagaggatcacattttcttgtgcaaataaaaggtggtagagttaaaaggtggagatactgaacatgaactttaagcccctactcataatttgagcttcagtaacattttccagtaagtgagaaacaagagaaaacacagatggcactgtttgctggcagctattaactacacctacaacactattgtgttgtatatatgcatacacattgagatttatatatattaagatgtgttggtgaggagcagaaaacaaatgcagctatcagctctatgatggggggtacgttattttaaaatgtcaaacaattttaacataattatattttacttttgacatgaactttgcattttaatcttaatgtcaaatattttgaaaaatctagattagtatgagggtgaaaagaatgaaacactataataatttggtgctcaggttctgaaaacatcaaacctggtttgaatctcagttccaccactttctagctatgtgaccttagcacataacatcatctctccaggcctcagttccttcatttctaatggggaaacataagtaatagtggtaccaattcatatcgctaatgttagaatgttgacaacgcaaagcagttaggacagaacactgaataaatgatgactaaatattagttactattatcatcaataggaataaatataaaattatgatattaaaaagttatgtctgagtccatttggcttgtccaccctctcccccatgatagtcttccctgaaaaacacttgacacttcaagaaataaggtaacttcctttagactaatccaaaatttattttctctgaaacttctcctggagaaggcagctgataaagtacctagttcaatgcccaatatataagacattctagcaaggacttctatacaaacagaataaacaaagatgagaattaaaaagtgattgttaatctaagcacaaatgatctataggtaagaactgcctggtcaagtaatatttgagaattcatagaaaaaagaaagtgaaacttatttagggcatcacattgtttgagaagtttttccttttgcagaaaaagtgggccctaagactctcaagaaaatgatccacttaaagaaaataataatatcatgatactgttcttaacagttcatctcaattttgtagacttatatgcttctgccacatgttaacttgtcttggtagtaaaaagacaaaaacagatggatgctgattgcttaatggcagaaatatttgtctgtagtttttgctactttataaaatattacaaaggaatacagaggtgggccaaaacctcaaacttaattgaaactctctagtgttgtctgacaaattaagattgtaagtcactttattatatagcgtctggtcatgtggtatatcatcaatgccaattatttcttttttctttaaaaactacaatcactacatatacacagttcctgcactcctaagtaagaggttttgttatacatagaagtaagcaagtttaatgtactcatttcctaagaaataagagaattgtcaatgttaatgttatccaaaaacgtgttcttaatgctcagtttgtacctatcattaaaatttaatataatctaacacaattatcatcaatgggatgcaggtgttggataattatattagtatcaacacgacagtcaaattaagatttcttcccatgtgatggagttctgataaatatcaattcattggtttactgaatcctgaagatcaaaaggccctgcatatggcactaataaatcaaatagagtcatcaaatctacagtctgttttctttggctaaaactgcaaagttttacttacagagactgatctacttctaaaaattctctgccaaaccaaatttgactcactaagtgtacagaaaatatagcactccccagccgcaccctcctggggcttctgaagtccagagacactgttatgtggtggtctagattatctggtctttccctcttctttgcctttttagatctcataatcaactaaaaattcttgcagaaaagtaaaaagttacctctagactcagactgaaaagttacaaaatatttttatttattaataaatcctaccataagtaaaggtacttaataaaaatctctaaccgattaacatacacactgaaaataataaaggggtctacaatactttttcctgagtctatttaaatatcggtaagaactcctaaagctggaaattctactcaggtatttatagtataattagtcacgttctgataaactgaccctaaactttgtgtgacagtagtattatttgaaagagaaggggctacggaaagataatgtaagcaatatcccaggaaaaaatcccacttccagttgatttacttaaggagactactctgataaaccatctgttccatgatattttgaatctcgaagaaaatgtacaaatgaatggtaggattatggtgctttttattttcttctttataaaacaattctgtacctttcaaaaatttttacaataattatgtttgaaatatatgaataaaaataacaaaatgtctgtttttggttcaatcgagaacatcctaaagcaataagaaatacttttccaagtccaaaaagattttagaaagacttaataatttgtcctaaaatgttaaaatctcagctgaaaattttggctgacaccactcccactcccaagtcacaacatttaaaaatgtctccagatagtgcccaatggggtggggtaggggagacactatcctaggataatgttttctcaagaagttacctacaagagtctcatataattatataccactaattgacagatgattccattttaataatgttctaatcttaagaccattatgaaatgatacttttggtctgataagatccatttcaatggtctctctctagcattgatgctaaggtgtattctgaagtaaactgcaatctgccttctgagatatttgtgttgcatctctccctttagtgaagaggacaatcactccactctggttctggtgagacagccctgttgtcccttaggttgaaactgaattcccatttccaatgggcactgccatttctgtatttcatatacagaacatgtagagatgccgtgccatttggttaacagggtccaaaaagtaccatgtgaaagcacatactttacataatgttatctgaaatgaaaaagagtttgcaattagagtaagtaaatacaagaatggtgttaccagtcagtttatgtttagggcaagtgttgttctgtgcctgaagtggcacaaaataatgtttcaaggagagtttccaaggcacagcatgttgaagagtaaggagaagggtcattcattcaaatacctctctggtcagcagtcccaagcctactacctcagaagccaataaacccaaagtctgacaagttagcctctgaattatgtgtggcttttccttcgtggctgtagctttgctaaagaaagaccaacaaggagttgatctggctcctgtcatcaagctttgtttggaggcccagtcgctggagtaatgaacattgcagaattggataaagcctattgacagaagctttcagctgtcacagtcatcactggaagtgacagactccatcccatggatgccccaaactcctattctaaagatgtgctggaatgagacagccaagtgaatatgtgactacatcaaatattctagaccccaaaaaattctcagtaagaaatgctaaccggattttatggccattagtattggccagtctgctcctatggtaaaaaccaggctattttctggatatatatataacattctgaactaaacctagataataataagttataggcctgctattactattttatccagatatccactgctctccaatatagaaattattattctaattgtcttaatgtattaagttgacttttcatatccttttcatacctggtaaaattctactattctactttttgctttgtgtgtaagttatctaaatgtttgtattagccacttttccctgcagtcacactagccaaagataaagatgaggacagaaaatacgtctttcttacttcggatcctctatagcaagagttggcaggcttttcctataaaagactgaatagtaaatgttttagccttcacaggctgttcagtctctgtcagagctattccagagctcctcaactctactcttgtagcatgaaagcagtcgcagacagtatgtaaacaagtggcatggctgtgttcaataaaactttatttacaaaaacaagcagtgtaccagatttggttcacaggctgtttttgctgatccctgctccatgggtacttagtacagcaatatcacacttaaagatgttagggatttggtgaactttgttacatcagatttctctgatttagtttatcctattactggtctatttttgtttgaaaacacaattttggcttttttgtttttgcggtcgtggaggggaagcttaactccttcactagctatgcagttttccattccttaaagacactctgtcctatggcagctaaacaattttatcctgcaaaatagcagtgttctgaccttgttgtccaagtttctcagagttactgtggaagacacaattgtgatatattatcctgaagagtgagttttcatgccaattatattgttgaatgtatacaaatgaaagtctcatcaataaaatataataaattactctctaccagatagttcctttgatatggcaacatcttagaaaaggcagtttgagaaaagttacaaacagaattctcaagccaccacaggaaggctatctaaaggtcactcgtttagcaaatgcaactcattgtttcaaaaattcaggtattttaaatggataagttttaaatatctggaagttccagttctataaacagaaatacaggcaggactggctcattcaggagggcagcggagagtgggggttaacatcacaattgccccccaaaaatacctaatcaaatgaaacaatcacctgtgctttatggccaatttgatgtttatgaagatcagtattttgattattacctagatgaaatttttcacactagactctgtaaccaaattgattcttgcatagacctcaaaacaaaaaggaagatcaagtattgatttagaaaatatgtacttgtttcttttgaacacttattctaataaacaacaaaactaaaccattagctaaaaagtaaaatcaaaggttgaagaaatttgaagatgacagtagaatttgtccttttttgtttataaagaaagctattctctggccgggtgcggtggctcaggcctgtagtcccagaactttaggaggctgaggcgtgcagatcacgaggtcaggagatcaagaccaccctggctaacatggtgaaaccccgtctctactaaaaataccaaaaattagacaggcgtggtggtgggcgcctatagtcccagctactcgggaggctgaggcaggagaatggagtgaacctgggagacggagcttgcagtgagccgagatcgtgccactgcactatggcctgggtgacagagtgagactcggtctcaaaaaaacaaaactattctccaaaagaatctcccattaaaaaacaataataaggtaattgtcaaaaacaaagaataaacaggaagaaaggaaaaaaaaaccaccatgattccaaaagatgggatccttcaagacagtttctcacgaaagttatatgccagcatattgggaaaaagagtgatgtcaccaagaataagaatgtgggtgagaccatatagtttatcttgtttttttgtgtgtggtgaaaatattggtaataactgacctaacgtgacattccagtggggagaaaaacaaccatctccctcaacatatatcagaattctttcagccttctcaagatgctctgaagagaaatagaaaattacatgaacaagaatgtcagaaactgcaaatgctgcagtaggatcagaaagtaatgtttcatcagtaacatattatgtaaaaaaacactgaatccacaaaaacctgttttcagccattcacggcagcattattcacagcagccaaaaggtgaaaacaatccaagtgtccatcagccaatgaacagaaaggcaaattgtggtatatccacacaatggaatattactcagacataaaaactaatgaagttctggtacatggtacaacataagtaagtcctggaaatacaatactaagtgaaagatgccaagcacaaaacatcacatattatatgattccattcatatcaattgtctagaacaggcaactgtacagatagaaagtagattactggttgcctgtgattgcctagggctaggggagataagagaattgagagttgatagctaaagggtatgggtttattttggggccagtgaaattgttccagtatgtattgtggggatagctgcacaattctggaatatactaaaaaccactttagaccaggcatggtggctcatgcttgtaatctcagtgctttgggaggccaaggtgggaggactgcttgaggccaggaggtcaagaccagcctgggtaacacagtagaaccccatctctacaaaaattaaaacaaaaaaaaaagccacatgtggtggcatgtacttgttgtctcagctactcaagaggctaaggcaggaggatcacttgaacccaagagttcaaggttacagtgtgctacgaccacaccgctgactccagcctgggcaacacagtgagaccccgtccggtaagggaaggaaagggaaatgaaaaaggaagggaaagaaaaccactttaaatgggtgaactgtatttaaacaaagttgcattttaaaagttacattgaacatatattgacaattgctcattaaattttttcttttcttattttgtccagtaaggcaacttgattcagctcctatattttaaaaggttaaaatgtaattaagttatgtatactttagggcattgtgtagtacatttggcccatcagattattatggaagttcctaaaatggaaacgttatgagaagcaaccaagggaagttaatgatgagtatggcggcaatctttccaatgaactgaagataaaatatgaaacattagccaaagaaaatagtagtagatttgatagtgttacattaagaaggacataaattagaaaaatatgttgagatatttggaggaaaaagtggtaagtttaaatagagatcttaaaagtaggatactaattttccccgagattgtaaatatagttagggctttaaaagcaaaacttaaaactttgttacatagaatgagatctactaccgaaaaagagaaagtagcactaatgtaaaatgaagatggatctacaattgtataaagatcagataaaagcactgatcccaaaataatcataaattaattcctttgtgtaaaacatcagcaaattttgtacatacaaaaattgtatgttattgaatgcctactatgtgtctagaaatgtcttagcacactggacaaacagtgctcaacaacccagatatgattcctgaccttagagactttggagtgtattttattgtttaaagtttaactgcctttgcttcaatatttcacatataccaagaactctggcaaattgactaacactcttcaaatatgaaaactacaacttctccaaaatacttacataagagggagcattaaagtttctttttcaaaagctgagttagaagtacaaattaacatttggagaaacaatttccttctataatagtaagacaaatcagatatcttatagattaaattgaggtgtgccaggcatggtggtgcaagcctgtaaccccagctactcgggaggcggaagtgaaaatatcacttgaatccaggagttcaagacttgcctaggcaacatagtgaaatcccatctcattttttgaaaaaaggttaagtaagcaaattggggtgtgatttacatgcttgcatgtagtaaaatgcacaatctaggcatacagctcaattaattttatatatttctacacccatgttactgccaccagatcaagatacagaacagttcacctgttggcaattttggacaacggtttgctaggtgatttgctggatttcttgcttggtcctaccaactcccctggggaattgggtagaaaaaaattttaaggcaactcaattgacatcaatcaatcattttgtaggaataaaatcacatctaagtgactgattatctgtgtttagaaaatccttgctaatttctaggacagggaaaagcagagggaaaaagaagagaaggaaatggaacaggtgcctgaagattgtgatcaacaaggtaaacaagataaggtaaacaaggtagtaacccagggggaactgtactcattcttcccatatttattttgtaaggaaggctgacagtatgagggaattattactttaaggcatgaaaccagaaagccctcaagctagatctaataggcaacataaagtgagcctaggcggatcaaagagcagcctgaaacacagggaatcatcatctcatctcacctatccatctatttatttactgaatattttcatgagaaaatatgccagcctatgtttatctgttcctgatccactttccgtatttacctcttgtaaatctaatgttattgcatttaatattacttccatcaactaccatgtttttcctaaaacaagacaggttttaaaaatacacaattctttgtcactatcaaatgtacttctctcaagcttaagttagtagaaggaagatgtgtatgtgataaatgtcgaactagcagctagaaattatgcaagtttgtgaaagttaaggttttagtatgtatctatgatttctctaattttattttactattaatataataaagcccaggtgctacataaggttaaagacagaaaacaactaaagaaaaagacaaaactatatggaagtcaataggctttctaaggagcgtcgtatcactggcggcttgccacaagaatcagctcaccttgtcggtaagcgggaacttcaccggaaaaatatccttcaatttgcttatccgaggcctcctgagctccctgagttaccaagaagccaaatctactgttaatcagaacactctaagaaacttctaagagcactacttccaaaataaagataattactatgtgtcttcccaatctcacttcctcaaaccatacctggtaattgtaagaaccttcagggtccagagattgccctctgaactatatttctattttgtcagctctttaaaatgtgacaccaaacataaggcccagatgcagtctgacgggagaagatgatagaactgtaatttgatatgactgacatacaatttttctattaatacaatcttagattgaagtagcttatatagagctgacaatctactaaaatccccaagatcctcctcatctccatataaactgtctctaaggcccatctcccttttcctttactaatcaaaataattacttaattttaaatgaagaaacttatatttatctttgttaaatttcactttcttgggtttaccctagcatttctactcgatgagaatttttttcttataattctggggttaatgaatacattatccctcccagctttgggttactggtgaacacagcttccatatctttatgaaatttgcaataaacataacaaataggacaggacaaaaggcaaagccctgtaaccctctgcaagagatctctttacaggctgacatggactctttaaatgcatttgtagagtgagtacaaatccatccatctcaagaatcaccaggtcctcttctaccttatcctaaggtatcattaaaagactgatgacctgtaatcccagcactttgggaggccaaagcgggtggatcacctgaggtcaggagtttgagaccagcctgaccaacatgataaaaccctgtctctactaaaaatacaaaattagctgggcatggtggcacatgcctgtaatcccagctacttaggaggctgaggcaggagaattgattgaacccaggaggctgagattgcagtgagctgagatcatgccattgcactccagcctgggcaacaagagcaaaactccatctcaattaaaaaaaaatgctgatgaggatgagccattgcattctctagtcaaccttataaaaaataaagaaattaggattgttaggtataataaccaggtaggacctagtgacagccacagtcttttccaaatgttccttaactacgtatttcaaattcaattccagagtttactgggaaacactataggacttaccaatcggcaatttctggaatctgaggatttgtcaggactactcatagaagattatgctcactttatcactggatgctgattgttgcatttcaaaggctaaatgctcacattactcacttagaacgctatctttaactgtagcactatatcatctacagtagaccttgctataaagatttcccttcgatttcaaaaatattcactgatataattaaatacaggtctgaatgttttaggttacatgctatgaaaaggtcagtgcctgaagactgtaaatatgtgcaatgcctctcttctttactccaacagctatgccttacataaccactttttattgcgtgataaaagtaatgctagttgacagaggagaaaagtcattattggattttttcaattatgtagtaattagtcatgcattttttaagtgccaatctaacaagaacaggtaaaactattttaagagcatagaaaactaagagtaacaagagaaagtgataactgtaacttgagatatatttataactagcattaccaatttttaaacatatataataaattggttctgattatttgatacttgtcttaaaagtacttcatcattgataagatttatcattcttgtaaagcttcatatctaaaaaagatttacagtcattttaattatccttcacaacaactctttcaaatcattcaatgccaccatccctgattctgattctttccatatgaggaaaatgactcatatgcagtttatagaattttcacctgtacaacacagcaaggagctggctggattctcatataggcttctggatgcaggctgagacaccaaacacagacacccaaagaaaaaggtccagggttggggggagcattgagggacaggtacctcctccagaattagaatgaagctttcgggtatttgccacttacggaggcagggaggcagagcagttcttccgatctgaacacaaaataagacactagctgtgcaaaaagaagatgagccgcagctttaagaaacccagctatgattcttcctacctagacactgagccaattagtgacctggccctgagttagagaattaactgtttaaggctactacagtgtcttagttctgatagtgcagtaaggagggggcattagggatggtgataaggtaacttaactcaatattcccactaggtaaatttggggtccacaaaggagacatcatgtctgggtgtacaactttactatctggaggcaagaactgatctactcagaatatggaactagttgtaacttccaccacagagatatcaccttttctgggggttacctttagtcacaaagtgttagacactggctgtaagatacactttgtaacaaacatggaacgtatttttaaactctttctcagaaaagaaaataaggaataaaatgctggagaaacagtatggagaaataaggcttccacaaaagaatgacatgccagtaaacaggaaatcttggcttatttcaactttttaaaatgggcccatttaaaaagctgtgcccaccctcccccaccaacttcttttttgatggagggaggtgtgggaagaggtttccgtccaaggtgacccatgtgagagaagagcaggtgaaagaaaggtcccacaagagtaaggaaagggcgtaatctcccctatgttcaatggtcaccacctgtgaagctaagcgtcagaggaactaaaccatagcgtctcccaaggcaacagatggagcaaatgaattagtcactgcccttcccaggatgctaggcacaaagcactttggagggaaggtggttaagcagcgcatcctgctgaaacaaacctgacatctgcttaatcttctcccctggcctccaactccatactgggtatttcaaatgggtaacaacttgaaagctccatgtggacttctctttcattattattatttcaaacgctaaatgttatctacttaggatcttactttggcttcatgccctggcagaaggcaagattttttagctaataagggcctggaggctttacaagaccacaggagttttcaaaaatattcctacatattcataatagtcaaattaatagatctgatgccagatgtaaagtggcattttatgtgtagctttaaaaggtactaatggggtaacttttaaagctactttaaaacatgcagctatgaatctaatgcaaaactgtttttgcctttcatgttggctatgtgtttactgctctgtaataaactcatcagaaaaaacttggcatctttctccctggatagatatttggcattcaggaaagaaatttaggttaaacaccttttagctgtcctttcagtaataattaaaagcttttcctttgacttagtgacatggttcacaaccacatataatgaaagcaacataaatctttcctgtgtggtacattacatgccctccgatagattaaaacatgccagccaagtctgcacttttataggctttaagctgttgaagagccaacaaaagtactgatggcagagcatcaggtaaacaggatgaaggaaaccatcggtaacaactgtactgtagaattttctgaatgcaggatcctgtgttcaggacagcataggcttgttcttggagaaagcagaatccctacctttaaattcccagttctattcagtagacaagatgaagcataaaggcaaaagttaactaatacatacgaatacagcatctataatggcaatgtcacctcatgaacagaaactatcaactaaaaggataaaatgcctactataaaccatattttcagggttttttttttaagagaaagtcatctcttttaacatcttgtgagtagcactttaaactttgggaactcttttacacatatagtccccctaacaatatgtgaagtaaggcatggaaagaaggaaagagggaagacagaaggaaactagaaatattcaggttctactggaatttacagactaccaactatgtgccaggtactttttactaccctttgattcacacaattttgtgagctattattcacatatcagagattataaaattaagattcaaagttgttaataagtattttgccccagatcacagagctagttaaactgtcagacctggggccctttcccaggtctcaagagtctttctggggtgttagtttttcaattggtttataaaacacagtttgtgttcctcaccaaaatatggacaatctgcttgcctgggcccaaagtgctatggttccaagcagattcctgcaccacctggcatatatttacaggagcacacaagttcagaagggaaatgttggtgggcgtagatgccgtcaaagctgacagaatctacaaactcatctagaaagaaatgcatgcaggaagtgaggtatgtatgacactgtcattgataaaatggaataatggaagaaagaaaaggcaacaaagggtgttgttgctggagtaaggcttatcctaactcaaaaatcaaggaaaaaagaaccacaatccaaggtgaggcacaatcaagatttctggctagtggagatctgtcaggtgaaagatgctagaactagttaaacacatacacacactttaaatattttgctttaactgaaaatttataaatacacattaatcaaccaatcctttgatgcagaatcaagcagttttcagtggggtctgaaaaatctttcttagataaatcacactcaatgcattatctacgatcatcatttatgagcaagaagccagagacttgtatagctgttagaacgcaggagtccttctagagtctgataattttttctgccttggtgttttataccttatttgaaagcatattttttcaagggattccccatcaggtttcaacttagttttcatagaaacaattgctttttgtacattattggtttctaaaacatttaattaacataattagaagaacaactgatacatatctttgggaacaactacattggcttctcagtgagtataacgttcaacttttgggagcagaagtacacagtataagctagcacccaccagcgattggcaagagtgagtatgcttttcaggcgattggagagaattgttatcagtgcaggctcattacttgagcttcttttgactgcggaacatgtagggccctataaaagctgggtagaaaggcagctctgcaggacccatcagcatgcaaattacaacttaggggatctccagaagtgaatacaggaggcaacccatcaatctatatttacctaagttttagggtgtcttaataaggtttcaaagtacatgtgctgaggctatgcctttccttaagaaaacagaaggttgtgataacatcttcctttctaaaatgatgactgctgtctttagagttcattttttttctcttaataatctcagcatcccacagtgataaattatatttgggtataatttttgtctcatagatgtaatggctcttttaaaaccactcttagaaatgctacagtgtatccaatgaatataattaaatatatatgtatttccaaatacaagtgccaacaaagacacaactaagaccctaatttttaggggaactaacttcatcttccacatcttgtttctgtcactatgctagtgttcaatataactctctttcacaatacttgccccttttagttagaaacttatatcttttgcattttttcattcattcttctgcatatacaatgaatatttttaatttttaatttttttttatttttagacagggtctcactcaggctggagtgcagtgttacaaggacagctcatgcagtcttgaactcctaggctcaagtaatccctcacctcagtctctcgagcagctggtgtgtgccaccacactcagcttattttttagtttttttagagtctccctttgttgtccaggctggtgtcaaacggctggcttcaagcagtcctcctgcctcagcttcccaaatgttgggattacaggcatgagctacatggctacaataaacatttaattatacggttgtagttactcagatgtgatggtttaataaatatttaacagccaaattaagcttattaatttaaagctattctgtcttgacaattatgcaacctgaggacacagaaattgggggagtgggggaagcaagtcccttttacacggtatacaaggggcattttacccgttccaataatttcaagagcactgtaaacattagagggaatataatcatatttcacgatcacaaagacagcaaaaacaaggtggccatataactttcatgttatcatgcccctgcacagcccctataggaaatagggaggcagaaatttctttcactgcaacatcctgttattgaaatttctctgaaaactatttgcttttttaaaatagagaagcaaatgtctcggaattttagactctgacatccctctgctgtctcaataaaagattagtttgtggtccttgctgcccctgtgttatttttgtggtttaatacccttcacggtgaaatcagctaaaaaacaaacaaacaaaaaaaacaactctcttctctttctgttggagttttcaagagctacacactccttggctggcttatgtactccaacacaaaggcaaggggctgcccgggcaggtaagagtgaaatccaatttatgcaacttgcttactgtgacctccaatttatcctaggattttgttatataaacttatttgcataagggtggcttacaccctgtactgtgtacctctgagagggccaagacttgtcttatttgtacagggagttctctcactcatgtgacctgtctagtccacctccataaagaagacagaccaaaaattccatctccagattacacagacatatttatagttaagactcctcgactagacatgcatcaattacttaagaggagtcttaactataaatacatacgcatatattaacacatctttgcactattaaactcaatatttgttgagtgccaattaagagccagggaccatgcaaagagctgtgagattagaaaattaagagacagggtctgccctcaaaatagtccactggtcaggagaaaaacactttaatatgacggaaaaacaatcatcatccaagtatacataaactgtatacatggtagatgcacaaaggagggaggggttagttggggtgtggcagattatttagaaaagtttcaaagaataagtgaaagttaaccaggtcataaaggactcagggtaatatactgggacatgagacagcatggaatagtcaaggaatcatggattgctaatattttacgatgactaaagtataggggagaagaaagaaagataaggatgaaacggtcagactggagaaggcttaaaagcagtacttaaaatataatttgaggcatgtgaaactgttcgaggctgctagggtaccaaagtcattcttttgaaaacaaataaatggaaagaatcaagcactgtgttttacttttctatacaaactactgctggtttggggggagaaagtagataaggggcagtttttctttataggtgaactctgacagataaatgaagaaagaacgatggaacaaaaatatcagcatttcacaatccctaatgaattaatgcttatacagcaatgagcatcaatggttgctaacatcattaaaaaaaaagagataatcttacattataggcctcctaataaaagaatataatctacccatgagatggtctggcccagaaaaacaaaactaaaacaaacaaaaaaacctaacatgactctgaccatgattctaactttgactattgacttacagaaaatacaccatgaagatactgtcaacaaaatccaaaaccagaaattctatgacaaccaagtttttctcctcttgcatcttcatgtgaaaaaagagagatgagggagaacctatagattaaagaaatgtaatacttttacaaattgcaagatgtgaactttatttagatttcaattcaaacaaaatgtagagaaaaaaacttacgatattttgattccattggaaatttgtccagtggctagatatttgatgatattaagacttaactaattactttagatgtgatcatggtatttagttctgttttttaaaaaagtccttatcttttagagactcatattaaaatatctataaatgaaataatgtatcttggatcttattaaaaatcataccaggctaggagaagatggcactacacatgaaacaaaactgaccatccattaataattgttgaagctgagtgatggtccatgaagggtttactattttgtgtatttcatgtatacttgaaaatcttcataatgaaggattacaaaaagaaaaaaaaaacatgttaaagagaatttggtacttagtccatacaagtgctgcagttttgaaactatggaatgtttcattaaactgccaattgtgaagataatattttgaaagtgacccataacaccataattttaactagttgatttatatccttttgcatattttcttctagaatttgtattttagaaagttttgtagagaagaacctgagaaaggaaagagacaggagataggaagaacaactcaaaatctccaacctcaattgagttaatgtgataagaatccaaactaagcgctgaatagaagaagcaggaggaggagaaaaagggagagtcacagacatttttggagcaaacctgataaggaatcataagcaaatgaaataagatctgagggaaaagaaataattttcacagcaccaatcactacctaaaattatagatttccttttacatgaaggtaaagctctgctcctatcttaagcattgtattatccccagtgcccaataacccataatagacagtaagtattttttgaaaaaatatgttaataactgattttctaatttaggttaataaaaatagatggaatatatatttacctaattagaaaacacaggaaggtgttttgggataatgggtacagctaaatcagttagggagtatgcccacctggcactaatgtatacatcatgaactaacattgtttttttcattaaatgagaaacccagtatgacagacaggatcagcatggcagctctacaaggtcaagaatcaggaatccagccccttcctgtctttgtgttcctccatactttccatatgcttctaacaacgtggcagctagagcaccggtcatcacttccaagttccagttccaggcaagaagcagaagagggaaagacaaaatggtacctaccagtgagtcagcttctttttaatgaacttccctgtaattcccacctaataactgccatttatatctcattagccagattcagtcacagaataatgtctaactgcaaggaaggctggggaaacttttttgttaggcatgttactgttataataaaataaacattctgttagaagaataagaggataatggatattgaatagataactagcagtgtctgcaagagatactttagaatatgttgtacctgggtatctgttctgtttcaagtacctgttgatcagaattgtccagttggtagcttttgagaatagttggcgttgaagaagatgtaaaaaatatattggtaacaggtgattgtccagggaccgactatataatagaaaaggagaaactgagaatggctaacttaatggtggtagaggaaggtcagcaggtaaaggagactcacacagagtgagatcaaggtaggtataacagagtcaaggaatcaagcaaaaagtaagtcaaaagtgccagtaaagtcaaagtcaatgcttaggacatggtttctacattaggatctggaaggcactagtgaacttttccagcggtagttttaagaacagtttcaagagcaaaagccagaccacaatgggttgaggaataagggagcttttgagatgtccatcagagaaagaaaggatatgaaggtgccatagtctaaaaagcaccagagttcactggaaagttgcagggaggtatgtttggtctgaaggatgactcattatatttgtagatagactaagaagaacaatccaggacagagtcagatactgaagaacctggagggtggaacggaggaggatctgggtttcgtccgctgagaacagcagtttgtccaagtaaaggcttcatttacactggagtttttaaaacctctttccatgtttttattatgaaacaatactgagacttttgatttgccagatacctaaatgtgtcattttccgttttgcctagtgatttttttcccccctgaaatacatcaagtcatgattattctggttggcaatatcccagagacaataaaggatgaccaggacacaaagtctatcaaaattctcaccaattaacttacatgacatcctttgggatttgcaccctacccttttttagacaagacatgaagcactgcaggtggaattcagctggggatatgggatatgaggttcattcattcaacataggggcacaggctgagatgctggaccaagaggtcacattggccgtacgcctgacaggcttaaataagtgtgtaagggctagtttttaaatggtaacaactcactaggaaccactttaaaatgttctagaggaggagagtttgggaaagtgagtgaaggatgtgcgaatcactgcaaactggaaatgatcgataatggcatgccaactgggggcctgcatccgagggcccccttttaaaaaaaaaaaaacaatgagacccctaggatcttgggcaagttattaaacttggcttccagttctcttctgcaaaattcaagttgttgaatgagatttctgaagtttcttgttctaaaaactctgtgattatctaactcatgaaataaatgctgtataaaactgtatgtgatttctaaatttggtcttaaaccttcaaaaagagtacctaagccttgagaggttttctaaatacagaagagagaccacagagctgttaatgtatctacaggcccaatgaagataaagagatgggtggcatataacacacaacctccctccttcaaatcttgttttttggaggaggtaaactattaggcttattggtttattatacaaaacacagaggactatgcatgacttatctttaaaggggaggaagtgacttgttacaagtctctgaaagttgatagacaatgacaggaggcttggtaaacaacagtaaatgtgctagccctgtctgattcttaactaagatcatcagataacttagcactttaaaataacccaccacaagatcaacaagtctgaggctcactttaaattaaaataacgctgcaaaataatgtgaactaggacacgtgaaaatagagtgaatactttatattactaaaaatgccctagaaattaggttatcttgagtagaattgatcagatactaaacttttttttgtttttcagaaacagtgtctcactcacattgcccaggctggagtacagtagcacaatcatggctcactgcagcctcaacttactgggctcagatgattgtcccacctcagcctcccaagtagcttgggactacaggtgagaaccatcacacccagctaatttttgtatttttttgtagagatgagatttctccatgttgcccagactggtcttgaactcctagactcaagttatccactcaccttggcctcccaaagtgccgggactacaggtgtgaaccaccgcgcccagtcagatactaaacattttaaactaaggtggactttgagaaagattctgcttttattcccaataaaatgaagcgttaggccaaataggaaatgacgttttagaaatatatgcaagaataaaaacacattctgtgatcatggattataaatcactaggttcctagactgcagttttgcctcccaatctttacaagaacccctgccaacatcaggtcttcacataatgcaattgataaaattacctaacaaaagctgtcttcatctatgacatcattaatattttgcttgaactaatacctgaatggcaatttgcatctataataaggtgagcattactaattattaaatccacattttacggctctctactacaaagctaaacctgtttagttttagtttttgattttgaaacggtctcactacattgcttatgctggagtgcagtgatgtgatcatagctcactgcagcctagagctcctgagttcaagcagtccttctgcctcagcgtctcaagtggctaggagtacaggcgtgcactaccacgcccagataatttttaaatatttttgtggagacatgatctcactatgttgcccaggccggtcttgaactcctggcttcaagcaatcctcctaccttggcctcccaaagcactgggattataggcttcagccactgtgcccagcctgtctagtctttttattccaagtgtagactcttgtaccacacttcctggaccactcctcctgagcccacaaagataattgactggccaggtatggctatgttcctgaggaaggaaggaagccctaccttccttcctcagatcctccatgagcgcaacctttatttattttattataatttttttctgacataatccacccggagatgcatgagtgcaacctttagataatacaatataatatcaatacaataggttggagccctcgtagtaacactggccatgtccttggccctagaaatgagatatatgaaacaacctaataacattagggaaaagttccctcagatagactctaaggtaccacagcttttcagtactttctgcaattctgcttctcagaaaatgatattaggttacataaagcaagactcaatcagcattttagaaatcatgccagagtccattactcacacccaagtttccaagtactgtggctacattttatttcttactcttcccttttcaccagaatgtggcaccactaccagatggtcagaggatgtcagatgatgggaaggttaacagtactaaattttattttctcaaaagtgtttagtcaatatcacagtggttttaattcgacatgacttccctctgaacaaggtttaatcatcagtggtacaatacaagaagcatgaattttggcattattcagacctggattcgaattcttgctctgtcacttccacctgtaagatgagaacaaaagctatcttacctattgtatagattaagtaagaagatataaaataaaagagtcccacacaggtctaccatggagggagtagagttcaataaggtttctttcattcccagtaaaccagtttgataaattaactgcaggaatttatttatgagattcttcttcattctcagagaggataacacaaactatttacacaatttgtcatcaattgtttgtgtttttttccaagttgtttcctcttatcaagaatgccttctggccgggtgtggtggctcatgtctgtaatcccagcacgttgggaggccaaggagggtggatcacctgatgtcaggagtttgagaccagcctggccaacatggtgaaatcccgcctctactaaaagtacaaaaattagcagggcatggtggtatgcgcctgtgattccagcttctcgggaggctgaggcagcagaatcgcttgaacctaggaggcagaggctgcagtgagccgagattgcaccactacactccagcctggataacagagtgagactccacctaaaacaaaaaagaaaaaaagaaaaaaaagccttctcctgtacccccagcagcttcttgggaggctgaggcaggaggatcactagagcccaggagcttgagaccagtctgggccatatagcgagaccctgtctcaaaaataaatagaaagtcttctcccactgaccccacaccctcatctctactaattcatgcctctttccttcaaagaccagctcaaattctaactttgtactatctggaccacctcatgcagtgaccgtacataggaagtacctaccacatacatatttttaagcgttactgaacattattagagtaatgaaagaatattacaaaccattaaacacatctagaagaaaatgtttttaataacttaaagtgacatgatagtttatcatacttaaaaaaataggagtgtcacataataaagcaaaggtcagcaatttattgtttaaaaaccagtaccgtgattctaagcactgaggtctcaaaccagggccactctagtaatttctttctttctctatttatttaaagtaatacctgagggacccatatatgtattttccttctatgaccgtgaaaggcaagaaaattaccttttctgtgtcacagattctgaatatttcttcctatccctgtactcccacatccctaacctctatattttcagaattcaaagataaaagtgttgtcttcaaacattttagtaaatgcttctccatattatcctgcttaatagcaggatctttgactttatctgggaatatatcactgcacaatcacctttggtgacctaaggaagctgcttaggggtgatttttccttgtggaccttgacactgcttgcaaagtttacagtcataaattgtaaccctctgagaacaatttctcaaacttggttaaataattacatagacaccaaaagaaaacaaccctctgtctactcctaccattgcattatcttgtctcctaattcaaagaaagcacagcctacattttgaataacttagagaggttataacatgaatttacaaaatgtaactaggaaattcagaaaggagtctccaaactggaggacaccatttgttatttggtggcatcttctgggaaaggttgatattgcagctcagctctgtgaaacataaattctcttgcaaaagcacatgggaaaaactctggaaacagaaaaataatcctgatgatatagtataataaggtgcaatctagacccaagagagtcagttttattttaagtgaggatgtgtaagaagctagaggctcctggatgtttcacagctcttccctcaatcctggctctgcatgccaaatccacctatgaggacaacctgtcacctcctgaaggccactggtaaagcccaaaccaataggtcaaagaaacaggattcatatgggggacaacatgagatattcaaggctttcccagcagcactgccaacttcatgtagcacacctctacaattttagtatgaatccaaggaagaataagatttgttttaccaccaacctcctcttaggtaggtacactacctatcaagtgggttcaaatcctagctccatcacttctaaagatggcaaccttggggaagattcttcatcttggagcctcagctttttcatccataaaatggcaataataataataatacctatttcacagagctgtctcgaggggtgaatgagttaaatcatgttaagtacatagaagggtgactaacagactaaacactcaagtttagctatggctataaggcatctctgtggtatggtaatgctagtcttgcaaagcccatgttgagtcccattgttggctttatgtctaaagatgacaaatgggataattccatcaaatgcataggtcataaagcaagaaacaataatgcattgaataggtgatgtagctctcttaaagaaggctcacagaatttattggaagagagattctggctcaatacatgtcagtggaaatgctgagttttgccaattgttgatgacaaccagctttgcaaagatagagcccctgtgtattcacaaccttctgctacccaagggcttctaaggaattccttaatttaagaactgagataccacactggccctagtatgtactgaaacacggaaacaaaaaggcctccaactgtttttttttttaatctcctttttaactgcttttttcaaataaaccaggaatatggatgaataaatgaacagctggttggcaaggctgcctcctcctcagtgtgatcacacccaacacagaaaaaaaaaatgcgttagaaaatagggacaggtgaaacatctccatgcacccaacaaagttaacttttgtctggtaatttcaattaatgttccacattgagcagaatttaccagaggaagaactgtaaccgttcaggtatttttacctccagttataaaacacagaaaacaggagcctccgatgagaacctgccccctggagagccagggcagccctttaatgaatggcctctccagctgctccctcaccatacttacagactttacagctcttgcatgtgctggaattacaagtcattaaaaagccactttgaaaacacaataaagaccttcttctctgactgcaacaaccttccatcacataaaaacctaaggccaatgcttcaacagcaggacgtttactaccagctccagacagtttaagcagggcaatgaacagggtggggcgggaggaaatgagaaacaacaaaagaagggaagttttttttttccttctttctttttgaaagaaatttctggtaaggtgatttaaagcatttatcctgcatcggaatcaccatccacccttgggaaaaatgctgccaactgatgagattttgtttttctccttcaagaaggttttctccaagaaaaccccttggtaagctccaactatcaaaagacatgactgaaatctctcttctcatgctgcaggctgaaggatgtaacattttgccaaatgtaatttgtccattttcagggaaagatcattaaaactttttacttcttcactttaaaattatgattaaatcctcaaagtaaggcaagaaagaggaaggcaatgataagaaaactaccaccataactgaatctgatcatacgtggttatctcaattttcatttactgtttttttcctcctctgctgtgaataccaaacttcttcatatcagaagacaagatcaactctatacacttctcttcaggagcaaaattatatgaaaaacaaaaacaggaattacagaagaggtgaaagatatttggttttttccctattatcaattaaagtttaagcaggttaataaaaaatacaattataaacctttagttgacactgatacactccctttgcagctgttagtgtcagtcaccagtcacttacctactaaacagtaagtacagtggaatatcatgtaccccaaagagatgaactcctaaaccaggaaccactgtactctaatgggaatagcctcagttcttgaatgtaaaatattcttaacaaaaacattcccctatcatgctttctgtatttgctaaatgctcacccactataacacagtccttctgcctgtctaccttatccaagcccctaccaaattcttctgtaggggaaatttgttgacaaactttcatgtgacagtattacatctctttatgagaaacatttcaataatcacaaaatgtatttaaaaattattctttcagttatattaacagtaactcaaagataaatcatttcttaggatattttaacagcaacagcagaaaacaaaaatgaaaaaacaaaaatctaccaagtgcctacccagtgcagtacttggtatgttcttgtcctttatctcatttaattaaaaagctgaaagatctgagacactttggcttatctttcagcttaaaacttaagactttttatcttgtatttttacattgatcatgtagcagaaccatatcaacatcaagaccatacaccttgtgacgacaaaattcagagcaaagtgacaaaagacaaaactcaaaacaaagtggcttagagtaccaaatattgcagcatataaacccacaaccttgaaaaaggacaccagagttctgcaagagaaaaaatcttgagtttgaaagagaaaaaatctctttcaaagctacaggttatataggtacccagaagtcaagtcatacatagcaatagctaacttacattttttttattagtgtgttaacgtttcacccacattgatttattaaattttcaacaataatcctacaaagaagatactattatgatctccattttataaaagaggaaactaagaaacagagaaagttaaattatttgcccaagatccctagtggcactgaaatttaagacacagcctgtctgacaccagacagcagaattctaattacctatctacctacctttcacttatcaacaaataagtgatcgatccctcaaacaccagccagacatacaaaccatggatgtccaacttctttctctcttctcacatacaaaggatatgaaaatcctaccaaaaaggaccatatcaattaataatctaagcttcctaacccatcttaatactactgacatttttatataaaacctgagtagaatttgattctagaaaaggttctttaaaatgttcatctttttaaactataagacctatactgaggcgagatgttttctttatagacatactagacaaataatcattttccccagccttccttatacttcaaattcttctgatttatttgtgtcttttttctgtttccaaagtccatgatctctgcccattatgtctaaaatcacccatcaccccatgtcccacaaatgaatacgaatctggctcatattcaactaataaagctggaaaggaccttagagagatcaggtcatctaatcacacttactcagaggcagacacacaactaggacaatgtgcacagtcacccctgaagttgggcctgccccaagccaccaagtcaattactagccaaggtaacaggggatacttgtaacggagagcactagcagtccatagcagtccatagcttagtgttctccattacaagtgtcccctgttccttttgtcttgctggcaggagggatgccaggtaggacaggtaggagacagtccaaacaaagcctgtcttttctactggataaatggaatttcaattctctctcaccttcctttgctcatagaaaggcctttgggttcatggtttacatgacatcacttttgttaattctcttctgttacgctacctacttttcaagtattgaaccaatagcaacaacaataaagccattactagtaccagaagactaataaggaaagtacggctgttgggttttatacacaaatagtacctgaaagtctttacaggctttctcagcaatgctatgcagagtacattacaaaaactactattgtaatcattggatttgtggctctaatatgtcatataccattttgaaaatttactacctactgtaaagttttccaattctaactcttcattccagaagacttttcaaggtatactttgaataaatacatcaaattgaacaagaattttattaaaaggaagacatactttataaatcatatataaatgggagggagcaagaggcagacaaaaggagaataaacaaaattacctaaagaggaagaccatctgtgtttcatgtagaaagagctttcaatgatgctttatgaacgccatttggtcttctcataaatcggcaaacattctaaaaaggtgcctttcaaaattttgaccactataagaaacacacacaccttctctgaaataaaattttcataagccattacttacccatactaattatagttttctgatttttttaatgctagtgatacgttaaatttatttcacagctcactagtgaatcacaacccatgatttgaaaacctctatactagaagaattgcaatgtgttagaatataaaatggcaaagttgcaaaatttgacaattttgattgaataatcacaacccaacagcatttcagggtgattggaaacaaaagtcaaacacacacaaaaaaggtccaagtaacatctgcattaagaataagcttcaagttaagaggaaaggtaagaagcaaagaaggaaaaataaatacttgagttattggaacaaacacattcaactctcatctccatttcataaattatgactataaagcctttaccaaatactggaacaaattttcccaatgtccagtattttatatgctactgtcctaatctgatcttctaccaaaatttcgagattagctatagagagtagggagatctgtggaccactggggatcagtgtcagcaccatgtcctgaccctgactggctttctacccagaacagtacaaacccggcacagcaaatctgctactatgccctcctagcctttgccagcatttaaactagagacatctgtgggcagcccaagggacagaaagaaaagtgttctaagattgccagttatttttagccagatagcttccttgaccattgcctagaaatacggtcaagccaatgtaaggagattattgggactgatcattactaataagtaactgaaaaaaggccaaaattagaaaaaatagtgaagtaaggagataacttcaaagtaatgtttattcttcaaaaacgttatcaaatacttttgaattagtaacaaccctgtcactagaagtgtaaggtttactacagaggttaaaatagataatctgaaaatcccttccactgctgaaaatctgtaattataagtttaaaccccaatatcaaaaaacaccttttaggggaattagatggtcagatgctctcttaggcatccacaaaggataatcctacccattagcaaaaacttgtagtgaatgaagatcacataccccaccccttccaaatcagtggctaaacaatgaagaaaaatattaaatattctctttcaaaatgctactgcctggttttacaggtatacacaaatgttaaaatttatcaaattatacattttacatatgtgtagtatattgttacatcattttgcctcaataaaactggttaaaaaaatactatcaccagccttctatcaacataaacatgttacttcattccaatgatcaaaacatcaacattatagccctaatattttctaagtttctcttttaaatttattttcccttgtattcaagttttattatattcttctcactttcctaagtcatcactcattggaaagcatagataccaagctttgatgagcaacaaaattttctgctgctattcaaatgacccattataatgctatggaaatatctttcctttaacaacttaaataacagcctaaaattctgcagattccttaatgacttcatttcttccttctcattagttaaggaaatgcatttctaggccagatctacctctgtgctaccattttatggctcagcattcattttcttccctcattctttattacaaagctatccaaaataaaatctgaaaataagggaaaggaagaaagccagtaagaactactcacatcagatttagaggatatattctcctccacatctgaatcattgggatccacaatatcatcaaatggcggtaacgttgatttcttcttctctgatgtctcactttcaattttgacctttcccatcttgacatgagatttatcttttatctgttttttgtcagcagaacaagtgagtatcagtggtggtgcgctagaaaaacttttaaataaagcctctgagctactctttttcctttttttggctgagagttcttcagaatctgaaatgggcggccttttactaggagccttcttatcttgtccactggtgatggtgagtaagttactatctggttttggctcttttgacatgggtttaggttccttgaaggccatcttaggaactattttctcttctttcagtggtttattttctttgggtttcttagaggattctttggaagatttgttgtgatccctggaaggttctttgaaggcacttttatgttctctggagtctttagaaggtttttccttgtgctccttcattaatttgtgaggctttgaaaaactggtactactgctgctgctgctgctgctactgctgctgctactgctgctgctgctgctgctgctgctgctgctactgctgctgctgctgctgctgctgctgctgctactgctgctgctgctgctgctgctggtatgaatactcctattagggtcctgcaaaaaggggagaagaaaatgaaactcccaaaactaaatagcaatgaagagtcaaaagagatctacataaaatgatccttctttgattcctctcaagctatcattaaaataccaaaaatattttaatataaaccaaaaaccacaatataacaggtgagaatagtgtatgtgagaaacaggtgagagtaggttattatcaaataatttaatgaggaaagctgttttcttaatcatctgaagcatggagttttaaaacatttcaattcaacaaatgttaactactgcttgtcctagaagatacaaggatgaataacacatggaccccacccttaataactatgacgtatctatgattgatagatgttgacaaccaaaagacgggaactattaattctgttgggagcatggggcgaagaataattcaaaaattcataaagaagtaacatctgaattaggtcctggaggataaacaggtagttactagaatgaaaagaatggaaaggtacttaagagaccaaggaccagaataaactaaaacaacagggagcaaagcacagattgtatttggggaacacccagctatagaacaagattgagaaggaggcagaaaaatagcccagcttcacatagtaaggtcagattacattaaatttcaaatggctttgcaatataaggaatcataaaacccccccaaaagaaataaagtaattctcaatttgagataaaaagcaattatttttatgctgtataaaatttcatcagttaagaactgtatctctcacccactaggaaaaataaaaggaagttaatagaacaaagatttcacctaaccatcaaatggactagaaagtctttagcaattactgtattttgatcatgagaaaagacgtaattgctgcctatttcattttaaatatgatcaatttttccactcatataaacatatcagaatatataacctatatataatctttctgtttaggaacaaaatctaagtccatacttaccatatttgtgaacctctaccattaatagtaagaataagaaacagagaagatcctggacatgcaaaaatccacatcaatactaaaagaagagctctttcttgcttacttccacttcctaatggaaccaaagacaaataaatgtccagattttcaactagaatttacatcttcaggcttgcttattatctttcaccctaactcacccatttaagccaatgatatgtaaaccaatcctatattccttaaatatctagcatgacacaggacagtaagcaagcaggggctatgcttttcactaaaatgaacaatctacttattgggtatatgcaaaaacaaaacaacaaaaaatatatatataggtacatgtataagcatcacaaagtaatatccaaatgaaaacttattgttctatattagtagaaatatattttttggtttcttaataaatttttttttgtctcatttgctcaacaacaaaatgacatataacaaaattattccatttattttctggagtggtttcaaaattctaaactgaatgaagttactaagcaaagacttgtttttatgcactaaattagataattccttagaaaacatcataatctgagatttaaaaggaaaattctaaagataggattcatattactaaaatttcattattttataaattctattacatttcctgtcatgttaagcaatactatgaataattaaaataaagtataatggacaaaccaaattaaggaacaacattttgaaatctaatatccttgagtttttttcaataggcttgttgacttactgatttttgaaaatttgcaatcagtattctaattatggctctagaatactcaagtatcactgtttaatattcaacctatatgaagtattatacacatattttgtaaataagttttaaaagcatacaatttttaacctaccaacatatttctaatgttaagtattaaaaaacagcaacactccagcaccaggaaggaaaataaaacttctgtatagatccttccatgatatatttttaaaatccttctttagaacaaactggaattctttaattcagggtacacattggtatctgacacagcttcttgtgtcataaaaaagttaagttccttttttaattacatgcatataatgctaggtacaaaactctagaaatatgtctttttataatgttttacttctcatgttggtctgggtattgaatgtctactgttacctttttatccactcaataaatcttggtacaagcaagtgacccagacattcttgttctttccttttttgtaattaccacctcaaaaatctttaagctaagagaacaaaagaggacaaacacattccataacaatgtcttaaataaaatttaaaaaataaaaggagagagagcagtttttaaggcagcattttctttgtcctgggcccatgaccaatgtcaaagttcaaatatattgtcaccagtctccatgtttgttcatgtaatacatgtaaaacagtggctcagatacacagccagacattaaattgtcactgacacagaataaaagctttcaccgattttcagcctatctatctgatacttatatacatatgggggtcttgtcaccagtctccatgtttgtacatgtaataaatgtaaaacagtagctcagatacacagccagacattaaattgtcactgacacagaataaaagctttcactgattttcagcctatctgatatttatatatatatattatatattatatatatatgggggtcttgtcaccagtctccatgtttgtacatgtaataaatgtaaaacagtggctcagatacacagccagacattaaactgtcactgacacagattaaaagctttcgctgattttcagcctatctgatatttacatatattatataaaaatatatatattatatataaatatgtatatctgatatatatatataatatacatgggggtcttgtcactggctttttaaatttttcaattaaccattaacctcaacgttaagtaccactgagcagcacagactaattagcattcaatgtaaagtttacacatgtataattcaaattctcttcgcctgaggctgattaggacaaactgaatatcaagcaatctaacacagagagcacgtgtgcataattcaaatctcaaatatttaaggcaaatgattgtttaaacataaatatacatatatttgcactaactttacaacctgtgactataggatacaatattttctctcatctattcagattgcactgaatgcttccttgttttaattttttggaacagaatgggtatctttaatgtttaatctcttctaatactacttgtcagcaactcaagtggaggacttaagaaaaaaatcagaactactggccagaataaggttttctgattatatgtggctttcagtttccatgttatctccaagtctacttttaagaaccactgacaactcatagctgattcttggcttccgtttcttcccgctggctatccctcttatttttggtctctgttctactttaactggcttctgtcttgtgaaagattttcagatcaatcatattttgttcaatgaaatttgcatatagacaaataaactctcccagaagagttttacttatcaaaaccaacaaactctcctagaagtttatttgttcaaactgcatttttacaaggacacttcctaaaaattgtagtgtggtccaagaggttatgcatatgtaggggtaggaaaaaccgtgacagtcaaaggtaaggttccaaaatacaagtctcctctaaaatgtcaataaacacacaatgaataacacagagggatgacaagccatctgaaactacaaatagctttgtgcagtggcaggatcatagccaatgaggtttatgcgaggcacaattactgctaactgaaactacgaatggagtattaaaattcagaattctggggtcaggggaggccttgaatttgatttacttttcccacttcaatcccaaatctaaccccatttacgtctcttgaactagttagctctgggggcagcaggcagtggcctgaagaatgtggccacgagctaacgggcgtcttgagaaaaataattggtgcaggatttgctctgcttgacccaaaagagtttatttgttttttttagagatggggtcttgctgtgttgcccaggctggaatgcagtggctattcacaggcatgatcactacatgctacagcctggaattcctgggctcaagtgatcctcctgccttggactcccaacaaactgggacgacaggtgcacgtgccaccatacccagcttccaggagagtttcacgcacacaggtatggccagccttcccagcactcagaaggcacttgatacaggaggagagtctgctcttagggctgcagaatgtaaggagatcagaaggaaggcacagaatcctctaggtgtataaacaagaaatagataatatgcttgctgctactgtgcaggttgagatgcctgtacctttcatcacttatagaattacaacagcctaaagtcccctaacagctcaacctcaatcccaatgcacatataagtgacatacttaagggtgggaggaaataggaggaagcagatctaacagattttctggaggagaaagatgaaatattgaggtcaaaagcagtatgactacttaaggagaatcaagtgaagtataaaaaataacttctggaaaaaaatgtttaattaaaaactaaaatttaaatatttatattctcaagctgaataattcagtagataaagtagaagatcgatgctaactggcagtataaaagatcaaatgaatgaaatttcaaagcacaaagtaaaaatacaaagcgatgaaagtcataatgggaaaagagaagagccttgaatggatcaaggaaacctaacatacagccataagaagagttccagaaggaagaaagagaaaagacagaagaggtaataattaaagtaatatggaaaaaaattttcataaactaaagagagggctgaattacaatctcacagagctcactatacttaaaaaaaaagggaaagaaaaaaaaaaacctgacaagtatccagaaagaataattacttaaaattgaataataattaaactcacattgtgcttctcatttgtaatactgaaatctagaagaaagaacagtaacatccagacagctgggagaaaaagaagtagaacccaaatatcccacacacacagtctgttgcgaaagaagtatttgccaaaatttaagaattcaaatagcacatcaaccactgtccccgccaaaggaaaggacttgagaaaagagtctagtcaaacaataactgaaccagaaacgttttatgtgtgggaagggaagaaatgaggggtaaaatgtatcttgcacaatatacagatttaaatctaaatgaaaaaaaaactgtaatataagtcctcaacatgaattcctgacacagaaaagtctaacaatctggacctaaacaactaaattatttccacagaaatttaggaatgaaagaggattagggtgtcaaggtgaaagaaagtgctggtatctttttttatgttaaagtggaataaaaattggattatgagcaattagaaaggaaggtggtcatttattaaatggaaaagtgcagaactgtcacataaagggaaaatggaaaatgaatatcaacttgaaaatataggcaaaattaagaaaagtgaaaaaagtcacaaatatgaataatgaacaaggtgaaaagacagtaataagatcaagtataacttagaataaaaatggaagaactgaattctccctctggaaaataaactgtcagactgggctaaaaagacaaagatcagataaaggctgttacaagaaatactttaaatcaattgattgaaaaaagtttaaaataatggaatgggcaaagaaatatcagctaaatgcccccaaaagaaagtatgagtgctagattaatatcagatcatgtggaattcaacgttgagagtaccaaataggataaaaaatgtaaaaatctaaattatataaagcaaaaggtatttaataagaagatttaaaaatacttagttaaatgagaaatcaatatatctttgtcataaattgacagacctcataaaacacaatgagtacagacacagtataattgaccaaaacaacccacacgctcatttaataattatacgtagaatttttctatctcgtttttttttatacttgaagttctagggtacatgtgcacaacgcgcaggtttgttacatatgtatacatgcgccatgttggtgtgctgcacccattaacttgtcatttacattaggtgtatctcctaatgctatccttgaataaagttcagaagttttatatgtatccatagaacactgataaaaatcaatcataaggtaacataagctttaaaacaccccttttaaaatgtttgtatagattacattggctaccctactccaagaaaattagaaaattaggccaggcacagtggctcacacctgtaatcccagcactttgggaggctgaggcaggtggatcacttgaggtcaggagttcaagaccagcttagccaacatggtgaaaccctgtctctactaaaaatacaaaaattagccgggccaggtggcgagggcctgtaatccaagctatttgggaggctgaggcaggaaaatcacttaaacctgggaggtggaggtttcagtgagccaagattgcgccactgcactccagcctgggcaatagagcaagactctgtctcaaataaataaataaaataaataaattaaagacaaataaatcaaaagaaaacaatgaaaatagcacttcatataaaaaaaactctggaggcacagaaaaacatgctccagggaaaattcatagcctttattgcgtttgttttttaaacaaaaaagaagaggtacaaggagaagagagaaaccaagtacaaagctaaacttagtattcactttgagaaactgggaaaagatccacaaaacatgcaaacattataatacccaacataatgaagaaagtaaaagaaacaagtttcaccaacatcagtgctttaattatataattgtataatgtcctgacatatatgtttagtgttccaatcctaaggagaaatttgccaagttaattctgacttaaagaaaatttacaatctacttctctacattaactgaaagaagtgaaatttcttgcatgtaaaatttcttgaattaaaaactcagattttccataaaaggaataagattaatgaggagacagcaatttagaaacatgtcaaaataggtacttaaataccaaaagaatcaacccatcaattggcagagaaagagagagagaatgtactaagggaaagagtgaagcaaaatggactgctgatgctttttataggatttttagcaagatatgagttcatattgtaaatgttttattaaaaattaatgttataataaaattataaaacagaaaacaccttaacaattggtaggattaatgtgttttaaagaatcaaaacctatttaaacaccgagtctaaacagagccactgagacccaaaatctaacatgtctcagtcaatgggcagaagactaaaagaacatgccacaagtggaagagaaatggcacttgagaagcccaagagtctttcgttcaaaacaatatatgtggccagtgcacaaaaaggacaaaaaatatttatacacactcaagaaaaagaaaggtctcctgttatgaaatacaatgctttggaaggttttacttgtttcgacttttgaataatctcccattttttaaggtgacattcaaccagaaagttagagggaactctacaatatatcctcgcagatccaaaataataaagccatttctagacctgaccagggaagagcagcagttttacaaaactaaagaattacatccttaaattcctcaatttacccagatctgtaaaataaccaatatagatataaccacacttacagaaatacaaataagtctggattttgcactaatgacgaaagatacagcaatcatcctaacagttaagcaagaaccaacacataacatgaaagagcaaaagatgatgctgaccgttcaaggagagattcgagagaataatgaaagattcccctcagccatacctgactatgaattctgacaattatttattaggaaagacaggccttaatagcagccgcaaagagtagtgacatctgggagtagtgacatctgggaaacaaaagaaacccacctgaaaactttaaagaggagatcaatattaactaatcactttaggaaggtcatctggtagcaatgtgggacagtgatggtgacaatgatggtgacagtggtggcagcggtaatagcttaatgaatgcttactaatccagactgatgtagaagttttatcattattaactcaacaatcttgtgaaatagctattattagccccaatttataagtgaggaaactgaggtacgaatatcaatgtgcccaaagacacatatataattagtgataaaactgacactcaagcccccagttagtctgacttcttttctttggagatggtcttgctctgttgctcaggctggagtgcagtgaccttctaggctcaagtgatcctccttcctcaccccttgcaagtagctgtgggactaagggcatgcaccaccactatatttttatagtcttaaccactacatttttatttacacttgtaaagtcagtgggtttcaaaatcagctgtcaatcttgccaatataacctgggccagaaatgaaagaagatatagaatgggggagaggctcaatgactgtaaaagaacatcatcaaaaatatgcctgttgtctaggcagaactatacaaatgaagttctatttatttccagtagagggggtaaaatattattttttggcaggtgattaaaaaatgcaatgggcccccctggccccccatatccaagggttctgtatccacagattcaaccaaccacggaccaagaatattcaggaaaaggccaggtacagtggctcatacctgtaatccctgcatttagggaggccaaggaaggaggatcacttgagcccaggggttcgagaccagcctgggcaacacagtgagaccctatctctacattaaaaaaaaaaaattagccaggcgtagtggcatgtgcctgtagtcccagctactcaggaggctaaggcgggtggatattgagctcaggagtttgagaccagcctgggcaatatagtgagacttcatctctactaaaataaaattaaaaaaaaaaaactagctgagtgtggtggtggtgcatgcctgtagttccacagctactcgcgaggggtgaggcaggaggatcacttgtgcctaggaagtcactgcactccagcctgagcaacagagcaagaccatctccaaagaaaagaaaatatttgggggaaaactcaaaataatgcacaattttaaaatacagtataacaactatttacatagcacttacattgtgttgagtagtataacaaatctagaaataatttaaggcatacaggaggatgtgcataaattatatgcaaatactatgccattttgtacaagggatttgaggattcatagattttggcaactgagaaggtcctggaacccatcaatcccctatgaatactgagaggcaactgtaatttattttaaaatcagaggctcttcttgtatacatttcaagtgggttaaactttgagtcttttggtactaaataaatatttttaagttgataaacttattagtagagttgtgttcagagggctcttgtgatactgagaaaaatcaccctctcctataatgccctggcagagcacatgatgcttccaattatttcaaagggtttcagaaaactgcaagatacttctcatctcacattaaatgttttcaaattttgaagtcataaaaatttatagtgctcaaatcacataaataatcacctccaaaaaggatgaggcgggagaggtcactgttttaagaaaactggagaatcttataagggcccctataggctgtcattaggaagagagagaatttgaaatattttacacaaaaacaggcagcaataaagaaaaccaaaagctacaaaaatatatggctgtgcaagaaagaaaatctaacattttagctgcaaataaacattctacctagtgataacaataaacaatattcactgattttcaacttttggaaactaatctactcagctccaccacttgctaagtgccttaaattttcttgtcagtaaaatgaggaccataatattaccacaatattacctataccacaaagtgagcctaatgattacaaaagcttaatatatgtaaagtacctatgtctgtatatgtgtgtgctttataaataacatgtatatgcaatgtggccgggcacaaagcaggaactatgtgagtgctttctattactaccaccaccactagtgcagacaagcacagaagacttaacattttattacatagcacaatgttatcaacccttacaacgtaagtgtctgaacagaagagaagggaaataactttaggataacctgaacttgagaatcaagggacattgtccatagttggtgagccaactaatatagttctacattaaacatctagaaagttataaaggtatccaagagatcaatttaaaatggtgtcatattaggtgtcattaaaatggtataatatggagcaaatgggttagattctcatgtaaaaatagcagcatagcatatagttaggaaactctggacattcaccttagaatttaaatatagaaacagttaaagtggttccttccagaaagtcggaaggaggttcaggaagattagaacataggacttctactttttgttaaacacttcgctatttttttcagccatgtaaatatcttcgacttcacaaatgtactttatcctcttccttttcatgcactcatttgcactttagagactttgtgaaatacattttgcattagaaaaataaaaagataaatgattcaacaatgtgactagtatcattctatgttttaaaaacacttcaattttccttctgatgtcatttgttatcttactgttttcgagcaaactacaatcaagcatcaatctacagacgtagcttcttactaagattgcactttgagttatatacatttagcttacatcattaataagatgaaaaaaatctacaaattatatttataattgagaaatagaaacacatgaaaaaatttatttcaactatgaagagaaaagaataagtagtaaattttcatttgcccagccttttgttctaaagaatttaaggtaaacccaataaatattttttaatattaaaaatatcctgaagtactgtatttgcacttaaatgaagcttaagtgtaaagtactgattggcaaaaatatttaatattttacaaaataatattttaaatagacaaaatatataatgcccttttttcctcaaatgactatgacttgtttcagctatgttgtacgtgctataaaatccttttgtttcagaatccaatttcatttaaaattctcctatttatatatactccctgacttgctatggcttaagttctaaatcatagttaagtactactgactgtaagttatatttagaagactgtagtttcaagtaaacttctgcctatctttgtggtttgaaactaaaaatttgaagtaatatttatatcacttctctttctaggtttttgtatatttagctttgtacagttcctgctttattaaaccagcttaaaaacacattggccagatcattccagccttctctcttagtactagcttgatttctgataattagccttgataaataatcgttaaataacagagaatagccaatcttcagattatattactaatcacaaataatggctggaagtataaaatgaaaaacagtacctgacacacacaaatttaataaatatactgcataaataaaagcccaaagagatgcaactgaacaatgggaaaatataatcaggtttatgctatcttgttaccttctctcagtagttattttatacatatttatgaggtctccagcatacgcaaaggaatatgctgaaactgttaaatactatggctttgcagaaaacaactcgtctaatttgggcaatatggtggactctttgggagttcttactatgatacaactagatattagataattacaacaaaacttcattgctgggccgttaaaaaaataaagaaaaagttcaagaatcaagagtatatgaaagagaaatagaaacataaaaggcaggccataaaatgtgaactacaatcactcatgaaagatggggttgccctaaggacacacgcatgactgtgttctcctgggtctctaaagaccaaacctgggccctatagcacatttggagacctaaacctcagagtctcaacagaaaccaagaagaagcctttacaaatctgctgttggggaaaaatactctgaattcaggtctcaggattcccaatgttcacctaaatcaaatacgaattcgcgatttaaaaatattcctgaacacaaagaaacaagccaccatgatgtgaggtaaaaggaccttaaagacttactatagggaaatcatcaaatgcagactataaataactatatatgaagtataaaaaggaaaaacactggaatccaaaaagcgaccaagcaataagaaattaataagaatgactgggccactgaaaagaaacaaatacgactttaagaaatgaaaaaaaaaaaacactgttggaatcaatatctcaatggactagttaaacagcggactgaacacagctgaaaagaattagtgaactggaagataaatatgaataaactgccataatacaaagacacaagaaaatgggaaatataaaagctattaagatacatggagaacagaataaaaataacaaatatcaaattagagacccagaaagaataaagaacatagggacacaatggtggaaattttccaaatatgatcaaagtcatgaatctacagataaaccaagtatagtataaaaataatatacataaattaaaaggaatttaatcctagacacattgtactaaaaatgaagaacaccaaaacaaaaaaactataaagacagtaagaaacaagagatcatgtattaaaaaaagagctagtggtacactggtgccagctaatagaggcttgactgggagccagctgttaaatttttaggaatttttttcagccagtttttaaacagtaaatgcactgtataaattaaacaagactattattttatataatataaaattgcaagcagagaaatattaaaagcagtggtaattaataatcaaaactcagcactttctaattagtttactacatattattatttgctgttttcttgaggtaattctctctgttgcataggatggcagaaataattcataactgtatgttctttccaactttgcaataactgatataatacggtgagagtatttccaccacacaaataagtaaacactaaaaatcatgactttttccctcagaaagatagttgctaaacatcagaaaaaccctaaatcagacttacaccagacttcacaaaaacaatagaaaaatattttcaaatattgaaaggaagtaagtaaaaacctagaattgtaaaaccagaaaaaacactttcaaaataggggcaataatcaaaactttatagattaacacaaactgagtgtttactaacaggagccttttagtaaaagaacatccacaggatttatatcaggaataaggaaaactagtttaagaagacattatggtaatataattatgctaaaatttaaaaacgttttaatgtttttaaaaaaactgtatatatttggaattataaaaatatacttcaataattttcaggttaaagaagaaattaaaataaaaattttcaacttcatcacattgaatgataaagaaaatgctacattaattttgtggaattaaaataggacttgaaaaaattttagccaccaatcctcgtctgtgaagaaaatgatggatgataaatgcacagaagaataataaactcaagcaaaagaaagactacaaagatttttgtaaccctaataaaacagtcaacaaagcctaaggaaagaactttgaaaagaactaataaaattcacagtcctcactgaaagactgaattaaaacaaaggagagaaagcgtaaatacagcataggaagaaaaaaataagaaaacatctacaagtatagcacagataaaacagataagaatatatcataaataattttattgcaacaaatgtgaaagcaaaccttgggaaaaatgtaacttaccaaagctgactcccccaaaaaaataaaaattaggaagaatcctgtattaatatcagataagtagtttgaaatcttcctacaaagaaaacatcaagcccacagggttttagaagcaagttctaggaaaagataattttaacgttaaagaaactcttctaaagaatagaaaagacaggcaggtatggtagttcatgcctgtaatccctgtggttttaggaggccaaagtgggaagagtgctctcttgaggccagaagttcaagaccagcctgggcaatatagcaagaccccactgctaaaaaagatttaaaaattagccaggcatggtggcacacacctatagtcctagctaatcagcaggctgaggcaggagaatcccttgagcccaggagttggaggctgaagtgagccatgactgcaccactgcactccagcctgggcaacagggtgacaccctgtctcttaaaaaactaataataatagagaaaaggaaacatattttatttcctgtggttaatattatcaaagcaacaaatcctaccaagaagagtaagaaaaagaagcatatggcctaatctaactcaagaatataaatgcaaaaatttttgaatagaatattagcataactaatccaattgtaggggggaaaaaaaggaaaaaaatctaatagaccaaaaccacattgggtttaatcccaaaattcaagagtactttggcgtgacaaaaatgcttgtcaagcactacattaacagattaaaggagaacaaaaccatctgttcatctcaatagatactgaaacgttttctgataaaatcaaaaattcatccatggtttttcaaaaaatgaaaacaaacaaaattccttacaaacatgactaggagataaattccttaacttgaaaaagagtagctaccaaagtcccatggagacaaccttctaaatagcaaattattagaatcagtccctttgtaatcagtttttactggtattcctactaactcaggactgcaaaatgcactggggggaaaaggataggaaaattggaaataagacaggtatgtgtcattattcacatttaattgtccacacagaaatacaaaaggatctgtaaagaattaataagtttagtaagatgttagaagtcatatcaatatcctaaggtagactgcatatttacacatcaggaacaaacaggaaacatttaatattaataatagcaaaacaaaatataaagtagctaggaataaataaagcataaaactacacagatactttaaagacattaaataacatttaaataaactcattgagaaactaggttcatagatgagaatattcttcaaccacagattcaatgtaatttcaattcaaatctcaacagtttttcagagaacttacactgagtctaaaatgtatatgaagaaaaaaatgatctactagaacttgttacattatatagccaacctctttatgaaatgatagtaattacaacattgtagtattgctacagagatcaacaaactgatcaatggaacagaaatgtacacccttccaaacagactcataaatattttaaaagctgatgcttgacatggcggatcattgataaaagcatagacaacgcaataaaacatgctggagctggtttcctatataggaaaacatttaaattagactcttacctcatacatacataaaatcaattccagatatttgaaaatatttcaatgttagacaaaacttctaaaacttttcagaaaattcaggagaatatctatatgaccttggtataggagaatatactaaatgggacattaaaaagaactaactattttaaaaatctgatcacattaagaatttgtttatcaaaagataccataaagtaaaaaagccactaactgagaaaactaggaaaatatgtcaatagtaaatagaaacaacaatgaactcctatctccaggatattaaaagacctctaataagtaaatagaaaaataagtggaagacatgaacaaacatttcacagaataagaaacatgaatggccaatgaaatatatgttcagcttcattaatgaacatataatcactgcaatgcaaaataagagaataatgatacaactttatgtgcttactaaatgtgcatagatgaacaagtctgacaagaaaatagaacaatgagatctcttttacatgctgacatgagactctaaattgctataactattatataaaataaaccaaggctaaataggtgactgctctatgacccagcaattttattcataggtatacaatataagacagcatttctctgaatgtagtcggcagaccagcaatattagtattacctagatgcttattagaaatttatatttttaggccccaccctagacctactaaataagaatctctgcagctgggcccaggagtcctcatgtttcttaattctccaggtaattctcatgtaccctagagtttgggaaccactgagttacagcagtattattcaaacagaactggtttaggtaaggctggaaagcaatatagtagactccataattgtttataagtcaaccagtacaaaattaaatagactgaattccatgtagtaaaggttaagcatggtttatgaaacttttgtctcatttgtccatgcatatttatttatgtatatgggtacttgatcattatggaaaaccggtttcttactatgggtcacggtcataaaagtctgaaatctaatgccctacagaaactcttgcatgggtatactagacatatgcacaaaaaggttcataattgcaaaaccaaataaaaaggggtaatctagatatctagataacaagacaatgaatacacaactcatgatataatcactctttggactatgcacagcagtgaaatagacaataataaagacaaatcttataatgctgaataaataaagcaagtcaaagtcataaaaaatacatatactattataccattttcataacaataaaaaataagcaaagatgagcaaacaaacatacatttatggtaaaaccatgtttaaaagctcaagaaactttaggaaggtaattatatcgagagaaggcaaaggaatcgagtgagaggcatatacagatagttagagtggtttgtaatataacatttttattataagaaaaattcaaaattcctgatgtcaaaatcttctagtctaggaagagaaattcacattcaaattcagcagatacttatttattagctgctatgagcaaaacacaaacacagtgtctcatttaatcttcttaaagagtcctgtgcggtaagtacttgataaagaataggcaatcaagtatgtgctcagtgaataaatgcttgaataattttataatattaaaagagacagagtttgattatatagtattatagttctactgacaggagttaaatgaaataacataactttaaagagttactaatatattcttacctttttttaccttatattacttattaccaaaagtataatgagaaaaatattcaagtcaaatcacttttttctatggaagtattatattgctggtcaaaggtgtacaaactaacaaaccgtagggcagaattagctgatacgtaacttcagcaatacccctttgtcctaatacgtggagttagctctatgtgcggcacatacagggtggggggaaaaagcagagctgtcctaatatagaaaaagaagtcaccaaggctggaaaaaaaatcgctttttttttcagtctatgcactttaataagaacaacagtttaaaagtgcaaaatcaaaatctttttgttcattgaatacatatcggcgtaaacaaacacacttgggaaacggctgccttacaaaattatttccatccttcacaaaaaactatttcccttcacagagctcctacatatgtatgcttttgtttttaaattttgattcactgttgtatctctccagcacctggactaatggctgaccctaaaaggcacataataagtatgtgcctttgaatgaatgtatacatttattgagtatttactatacagtaggcacctggggataccacatcaaatatattatagtccccatccacttggagctaacgcaagtgatgaaattatgcctttttgcccccttaacaattcagtccaaaagctcttatgtcgggccaagcaaagtaggcaacggtgaggaggaacggctacaggtggagagacacccgtacaggggctgggagccaccaaaagggcctgctcttcggagaaatgctgaattcagagcagggacaagaagtacaaaatgaacttgacatatctttttatagaaaaaggttaaaaagtatgcaaagaaaccaggttaaaggggctcccactggccaagtcaggaaaattaaattatcaaaataaataatgatagtaataggttataacccattgaaaaaatatatacccatgagtccatgatgataaaataaacataagaataaacttaagtctgaggaaaaatgggatatttacatcttctcaaagtaccttccaataaaacacttattaattacagagagaaactgtacagtggagaagcctggaggatgccattcgaatcaagtaatgggtgttaacatcaacagtaatgtctcagtggaaatcaggatcatgtgatgtggttcaatgagaagagtgcagatattcctaccaaagatgcataacatgaatctagttgcagggaaatatacataaccaagtatgtatatctactaaataactggcctgaagtctttaaaatcttcaagttcatgaaagtcaaggaaagaccaaggaactctttccagttgatggaggctaagacatgacaactaaatgctacgtatgattgtagactggatccttttgctatcaaaataaaggacagggccaggcatggtggctcacacctgtaatcccagcactttggaaggccgaggtgagcagatcatgaggtcaagagatcgagaccatactggccaacatgatgaaaccctgtctctactaaaaatacaaaaaaaaaaaaattagctgggtatggtggcacgcacctgtagtcccagctactcaggaggatgaggcagcagaatcgcttgaatctgggaagcggaggttgcagtgagccaagacggtgccactgcactccagcctggtgacagagtgagacttcatctcaaaaaaataaaaaataaaaaaataaaggacattactggaacaatctgcaacaaaactggagtaggatctgaggataacaagttaataatgtatcagtgctaattcctgacttggatggttgtactgtagttatataagagaatgcccttgtttgcaagaaataaattctaaagtattcagggacaacggagcatcaatattggcaacttactctcaaagaaagaaaagttttttgtaccatacttgtattacaagtgtaaatgtgagattatttccaattttttttaaattataaagtaagtaaatagtatttggggaagccccacatctcaatctatgcacagtggactaagggactctgggaagggcactgaaatcagaggatgtcttcaaggggccttcagtctgtttcaatttgctccacttggctgtctcttcaaggacccataacatactgtgcagacctaaattgcaccatattatcctaagaggaatcgaaatgccatcctgaaaggaacaaaggcttccttatacaaattagttgatctgttagctaaatcaagccttttctaataaaaggaaaggcagtggttttctctcaaaaatgccaaatgaggttgttcttctatctatatcacacacaaaaacagagcaaacaaaaaacaagcataatctgaagccttcagttcatctcctctcaactaaaatatattgtctcggttgcagaaaaaagacaataaacttgtaatataaattcaaaggtgtatttgggaaaaacatttccacatcttgttgggaaaatcagcttcacttaggatttgttgtagaaacaagacaattttacacacatgcactttgatcatctgatgatttacacaaaagatcagcattcttaaaaaaaaatgttgtttttgccatccttagtctttagagactcagagcctgcctggagtgggatggggaatggagtccaataaaaaagcttctggcaccccactaaaagaagcagatgtctgagtaccacagctttttctcctgaaagcacatgagggcggcctggactggtggctgtgaatttgttttgttttccttctttctttcttttttagagacagggtctcagtatgttacccaggctagactcgaactcctgggctccagcaatcctcctgcctcagcctccttagtagctgggactacaggtgctcaccaccacacccagtgttttttaaaaaaaagaagaaactgaggtagattattccaatcctattaaaagatgagaatttattatcccttaaaagttgaccaagggttaaggcttgatagaaagcaaaacaactcagtgatctttcactatatacccaaaatctggcattaagtgtggcccacagtaggtactcaaatacttcaaaatgaaaagtatttatatgtcctccagataaggcaagcactaagctaaaaaatgcctcttggaaggacatttttatttttgtttatttatacactccgagctatgtaggcagaaagtgggaggtgtaaggatggtatctgaaggaaaaaggagtacgggaagacttaggaaggtcctctcgaacttgattttcagaagcaaaagaaattagttttgtatagggaacttcaatctatgaagcagaaacaaaagaataaaaatcttctgccagaagtcttccaggacttgaaaagcatcttggatttcctgagcctgtcttatcggtcctagattcaaatattctcaaccatttttagatcataaatgctaaggactgtacacgcatggcggggtagtggaatatgactataaagaggccaaagtagctcccccagagaaaaggtagcaaagtcagccacggtaaactaattctattaaagggtactaccatcctactttcctaccctgagcggaaaatcttttaatatctaagcactcaaagaatcacaataccccatggcttacttgtatctctactttcaaaaccctggtagattacagttatttcttgactttatgataggctttttcatatgctgattaatgttgcattaaccatttttagaccacatataaagtcatgcataaccttgctgttcaactgagtaaaagaaaaactccaaaaattatgattgcctcttaacttacagaaaatgcaaacttaaccaatccccacagataggttgatgctggctttaaaaagtttaggggaaagggatttctaattatcatattctccacataaattgtattttcagaagcaagagaaatacaggaaactttagtctacaaagcaataaacaaaaatatgaagtccgttgctgccaaccagtgaactgcttcactggcagtttacccaagttgtcttcagaaaggagactcatgcaagattgctccattggtcctaatgcaactaagagaagtggccctggggatttttattttttaattctttgtcttcttttcattgcatttccaaaaagaaagctaatatcactatgtgtaaccgtagaaagaatatgcaagaacaatgaacaaaaaccctgactcagctatctcttgcttgactgatttcagtatttgatgccttagtttactcatctgtaaaatggtgaccttgacctattatatcaaagaatttcatcagctacaaaactgtatgatttactcattttatagccataaaaatacaccctgatccacatgcccagaatctaaatgtattaaaaataatgaaagtgttcatgggtttttcctaaacagcagtcactgtgctaatcatttctcatgcattatctcaagtcatcctcacaactactatatcctggtagatggtaccaacacctcattttacaaatgagcaaacagactgatagagattagtaatgtgcccaaagacacacagctactaagcaccaataccagcatttgaaaaaaagggctgtgctatgagtctgcctttctaactgttatgctgtatccattgcattaaaaaaaaatcaagatcagtatgcagaaaattgagcagtgagaaagttactacacatctcaatttctataggtgtcactattatctttaaggctgatcaatccaaagtagtttaacctaagacctgtgagacattcacattctatgttgctctgcagtacagaggcacatacatctgatgtcaagctattttcattttaaaaaggtaaatcagaataaaggtttaattacagctttttttaattaaaaaagaaaaataaactgaagccaaaattaagtgtacgtatataagccacaaaaatatcttccagaaaaaaataaaaaagaagagatttcagataaaatgatcccaggggttggtgtgtatagagaagtaaagaagctcaagaaacctgaccctgggagagggtgtagtggacgaaagaagccaatcccttctctcaagagtaggaacagaaatctaggaagaaaaaatacaaaggggacgtaagagaaatgactcaactagaagtagttctagccctggccctgagacccatatgaagagccaaatcagataaagtacatcttaaaactggaacatagtagaaggtatttttattaatgctgatctagaatattcctgatttagagctcactgatgatctctttgccaaagtattcagagctcaaaatcatcagaaaggaaaattccacttcacttaatctttactttaaaaaaacaataaataactatcttttgtgtgaaattccctacagcaagggctacattattcagctggtcctctagtttttgtagccatgttctttcaaaggattagcttggtctcatagtcactggcatttgaaacccctggtttagcaaaacagtcttatcaaaagtttttgctccctatgcttaaaccagacctttatagatatctatgaatgctggacaatagtgttataagctaaaagcacaaagcagagtggcagaatgagaggtcaagctaaacctttgaaagaacatgactattcaaaaccagaacactctgataacaaattttcaagaaagatgtatttattatttctccagataactctgtctagactatatcaaacaagatagctttaacatcaaaatcaccttttttatgaacctataaatagtgccactgcaaatggttgtccagatggtaccctgcataggaagtgtggccaatgggatgaggattagctgaaattcagctacactatgctagccatgccatgctccttgggctggggtgttatagagtggggagaggtagcagcactttacttatttatttagagacagggtcttgctctgtcaccaaggctggggctgtagtgcagtaacagaaattataactcactggagcctcaaattcctgggctcaagcgatcctcctacttcagcctcctgagcagctaggactatagaggtttgtcactacaccaagctaattttattttattttactttattttattttttgtagagacaggtctcactctgtggcccaggttggtctcaaactcctggcctcaagtgatcctcctgccccagtctcccaaaatgctgggattataagcatgacatttatttttaatttgcccaaagacacaatggtcaccatacgcatggacttctgtctatattacccatataaattcctatcttaagtcaccacaagttcatgtaaaggctgatatttgtaaggccaactaaatttttattttacttcattttactctaactgtagttgattggaccagtttgtttcatgaatagggatccttatctcactcaatctgtccattattttaccatttcacactacccacaggcccacaatgtaccctatagtgaaagggaaggtgtgaatcatatttgcaaagacaagctgcaaaatctacacctgcaataatctatattaaattacaaatcttaggccaggtgcggtggctcacatctgtaatcccagcactttcggagctgaggtgggcagatcatttgaggtcaggagttcaagaccaacctgaccaacacggtgaaaccccgactctaccaaaaaaatacaaaaatcagctggacgtggtggcgtacatctgtagtcccagctactcaggagactgaggcaggagaatcccttgaacccaggaggcagaggctgcagttatccgcgatggcaccactatattccagcttgggtgacagagcaagactccatctcaaaaacaaaaacaaaaacagaaacaaaatatttacagatctttccaaataactgatctatggactaaacagtcatcaggaaaaaaaaaaaaaaaagctagtacatcatacttctgtattgtcaaaaccatgaagagaaaatttcaaatttgtgcaaaacagttcttttgttctcaatgttaaaatttctgggtcttaagccagtaagtttaattttgagaagcagagcaccaggaaggggagtggggggatggcggagaaagaaagcaatagaacacattaatggtaagttctcaacaaccagaaagtttatatcaatcctctgaagtgtgaggacatagaataaagtcatatatgtttaaaatctatgcgttatgtttaatatattaaatgcaaaatatagattttcagtgggatctcatctacataaaaatataatgtgaaatactgacagaggttatagtcaccagaaagattacaatgacttattttcttcttttttgcttttctagatgtccacactttctaaaattaacacatacttatttcaaaatcagggaaaatgttagattccttcttgaaactaaaatatgttctttctggtagaacattattattatgtcaaatccttgtaatggaaaccttttactttcaccattccagataacagaaaattatggtttaaccaaaaatataataaatctgcagaaaaaaagtcatgtcaataaataaactaattatctgctgactacttaactatgtaccagatagcatttaataatctcaaatgggagaaaggagatattatgcttattttagatttatacaaacctaagcccaaggtaaattagcagcagatcctacaattgaatttgtgccttcagatatcaaatcaaacattctttctgttataccatggctatatcccctgtggtaatgaaggtttttatattaagccacctaccatctatcctcaacccctgaaaatgaaccacatatgcctacttcgagtctcagacatttgtttcttaaagtgttaccttcagatcctgattattgtcaggttttcttacaactcatggaacaagaaaacaggcagaaaacaaaatgttaatcatagcccccgttctcctcctcaatttcccctaaaattgttttcacttaatattatagagtatgaaactcaaaaatatctggtggggacagtcaaaataggcatctgcactcacagacaactcccttaccatcctagaagagaatgaactcagacaaagtattagatacactttgtatgcatccttgaaacaagtacataaagagctagtacctaagcaaagacgaaatagagaaacagaatcaacagttttcaactgcaatatttttgtatttaaacagagaaacaattatttcttaatctgaaacttctcccaacattcacatcctttcatatttttccttttctgttcatttcttattttcttggctttttgtgcaattggggacaggaggtagtagcaggattaagtgacaactttaagatatcacagcatttcctttcaaaactaaattacggttactatattaagagtttcgtacatacagtcagctaaactgctacttcggggaggtctgcagaaagaaatggggcacaccttccaatactgacaactaaacactcaaaacaacttttcttagtacacattctaggaacatctccctctctcctctgtttttctttcagtctttgcttagtttatgcagtaatggcgtttgagctttcagcagagtggaaagtttgctcctgtttttttccttgtcacttaaaaggtaaacaggtagttgggaaggaaggaacaaatgaagacacgaaagttgttttatcacacagatttttctggtacctattttcaaaagtctgtaactgccctgcaatcaacgtgtgtgactttaagaagacattaaatcataaaaccactaaataggttgagtgacataaataactttgtactgtcatgaccatgctttccctgaaataatttatgagatcgacattacatttggaattaaggctcacaattttgactttctacttaacatttatatgtatgttccactttcataacttaattttccagagtttgtggggggaggtggccgacaaggttatagaaagaaggagaaaatgccaaatatgacagaaaattagcttctaagaaataaccacacaaatgaagcagcctgcttcgtcttacatttatttaaataaaccaccttttatcagtgccagtaaaaaagcagcagcattcttttatcgtttgaagtgacaattacagaattatatatatcagaaaataatcaaaaaggtacttattccaaaacaaatatccaaaaatccaatgaagctgcccagtgacagccactaaaataatcttctctgtattattttctttgagtcatttttaaaataagcagccagctatccatctctaggcactgtctagatgagtttgccacaaaagccacttatatttttagaagccaaagtcttgacaaatcagttcctaagaacataatttgttacacatcgaagaaagcctgaaaacacagaccttggttaaagaggcttccgtatctttttgtaacctttccaaatgtaagtatgtgggaagagtacccataaatttaagttgaaactgaaacacttagaatatttccaatttaaaatacattaaaatgtggtctttgaaaggaaatgaaaatggctttttaagcatatgaaaagttgctcaccatcactcatgagagaaatgtgaattacaaatgagatgccatttttcatccatcagattgggggagagggtagtttaataaatcatcctgtggagaaaaaggcactcacgtactatttggtgcaggcatagagtagtataacctctttggcaggaaatgtgtagatgtctaccaaaatttaaatttcactttgccttggacccacaattctactctaaggaatttatcctacggacatatccatgtgcacaaagaactatgtatgagtttatttactacagtattactggtgtcctagaggaaaacctaactgtatgtcatgatgcactgtgtgtatatttacctattcaaaaaaattaaaatttgaagagaagagattgtgatccatacagttgagaaattagaagtgttctcaactcccctacaaaggaaacactaaaccaccctacacaagattcattccaaatccttgtaataaaatgctgtgttcagatggcttgacacagctgcattactgaaagctccttatcctaagatccttttggccctttaataagcaaaacccctcgctggaggtccactgtggacctgaatttcacttgacaataagcagcatttcagaaagattccaatttattccttgtgaaaacagatcatatataaatgtaactgtcactctcagaaacaggactgcattatgctgcagatttaatacagactggaagcatgttccccatgtcttctccagcaaatcttgccaaatgggcgtctgaaatgtcctactgaaacaggtggtgtctgaacagaattggatttctgcctatagaaaccctagttttaacaactgctgtggttagttttaattttcagtcctcaaaattaactgcttgccagtgattcagaaataggactgaacaacatgtttagactttgccctgtttaattgaggaaaggaaggaaggaaggagggagggagagaaggaaagagggagggaaggaagaaagaaaggcagcaggaacaaacaaacacccaacaccctaccaccatcccataaaaaacaacagaaccaaagcaggccatttggtttccaggccaaaaaaagaaaaaagaaactgcaaaataaacttgattttccaaagatgcttgcctattttgtgctttcttcgtagaagcacaaggatccaactaccttgctggtcatatatgtgaactcttctaaggaaacacacagccttgagaagcctttaatccgctaaaaattcagaattaagaacaatgttaagaatccatttttctaatgaaaagttacatcttacaaaataatattccgagccctttacacaagcaaaatacaaacaagcacttcatacaagcaaaatacaaacagagtgccaacaccttgaaggaagaaaccacgggctaatctttaaacacaacacagatctatcaatgcgctggttacactaacttggtggtaaacatgttttcctgtgaataaatattgagtagcttacactgaatagcaaatctttttcaccatacctttaagtgtctgatataaagatggttaagcatctgctgatattctaaactagtaactgaggggaaaagaactaaggtactgggtatctactatgtgccatacaccatggttacacgttccctatgaggaaaacactgccatatccgtttcacagctaataaactgagatgcaaaaagatgcaatggtttttcccagggttacccagcttgaagatgataaaggttttatctaaaccagcttgaatttaaaacttttccaattgtatcacacttctttccaaccagaaattcagaaaaacaagttagtagaataataaattttagttccccaatatacaatatctaatatacagtatatgtttactttgccaacaccccaaagaaaagctcatcttctttcatctatcttatagtaatagatgacaaactcttctgcaatgttttcagtatgactgaattccaactactaaaaagtgataagggaatagagagaaaattatctgtcgtgatcataagccttttaatcttaacatcctaatgagcacaatttgagaatcactgatccaaaagtgatcaatcagttcattctttaaaaatgggaaataaatagaaatatctcagcaaatagggaggtgcttctccacagagtacacttggtccttttgcttaaaattaaaagacatattatgtttgttcttgccctcaaaagtttactgctcactgctctcttccctctaccaatcaaagaataaagatctcaaaggaaatatcctcccttaatataataacatacaaaaatttatataataaatatgaataataatttttaaagtaagttctcaagttgttctttctcatttcataacccctaccctctttctcttacttaaagccttacaaggggctggacgcagtgactcacacctgtagttagagcactttaggaggccgaggggggctgatcatttcagctcaggagttcaagatcagccttggcaacatgggaaaacctgtctctacaaaaaatacaaaaattagtcaggtgtggtagtctgtgcctgtagtcccagctactcaggaggctgaggtgggaggatcacttgagcccaggaggttgaggctgcagtgagccatgactgcaccactgcactccagcctgggtgacagagtaagaccctatctcaaaaaataaaaataaaaatctaccagcctaggcaacacagtaagaccctgtctctacatttttttttttaattagtaaatgtggtggcgtgcatctgtagtcacagctatttgggaagctcaagtgggacgttcatttcagcctggcaagtcaaggctgcagtgtacaaaaatcaagccactgcactccagcctgggcaacagagtgagactccatctcaattaaaaaaaaaaagttcgtcgggctagatcttaaatcaaatccacaatttccccagcaagctcccatgagctgtctaatttagaggaaactactttcacggtcctataaagtaaatcactctgtattcaatactctcagaaaataatgtttgaatctaaatgtgccctgcccacaatacttcttcttttataacaagaatatacttaatattagggagccatgtcacagaaaaacacagggtatatttcttccaagagggacatacaccaagttttgagactatttaggaaatagtatgacattgaaattaaaaacaaaatccagtgaaaaaaacagaatgttattgacccctctcccaaaaaagttgttataggcttatagattatgaagtagaaaaaatctgcagtttttcaagattctctggcaaaaagttctttggaattattttcttctaagagctgaaaaacattttttccaagatgctcccagctctaaaaacaacctttctgatctcttgaaaagcaacactcaacttttagtagctctatgtacttttagtttaaaagaaaataataaaagagaaggaaccatagccaaacactaagtttactccacccatgccttaacttatatattaagatgagaagagaggttcaattattttttccttttaaggtagaatatatacatctatgtcaacacataatttttaagtatgaggaggaaagtatcctctctcccaccacaaaacccaggccaaaaaataagaagaagaagaagtttatctgaagacataatcgtgaactcatttctcattaaatcagaatggctcataagttagtaacaccatgataggctgcattaatactaagataagacaaatggttaaagccaggtatcaataatataaggcagtcaaaaatctaggtaagccaaaagatgtttattagtctactgattttttttacatttctatagaagtttattttaatcttcccatatgaaatagacagaatctgtggaattattatgatttttaatgaatttttaaatgcttattttactacaaaattcactgtgattagtcccttaagtaacttgtaatatttcaaacagcatatgcctggaatagttcacatttcaacttattattttagagttgtcaagacacaatctaattctaataggaaaatatctgctggcttcaaacagcacttaaacacaaagaaggaaagttagaagtcaagaagaatcattctgagataaaggctgagtagagcacaagatgagaaatcaactagagaccttatcaggatgcagtgctgcactttgctgcattatcactgactgtaacctctcttccagctcacaggcaaccctcgacttctctgggactaagtggttgctttaaaaagttcttgtgtcatatttacgttttcctacgacccttatcagaagcatgacgtactaaagttacataatttgcactctccaatttacccacccaactacacaacccaagagagataatcagaaatgtaaaatgccgaattcattaaaaaaatgagattgattaggattttaaatggaccagttagttgattgttaatggcatagccataggtaaatggcatcaaaactatactcctgataactataaaaggagtaaaacagagttacttttccaaacaacttctttaataaaattataataagttcctaattttaaaataagttgtgttacaaaaataaatacatttcttcatgaagctgtatttctcccatagaatactctaagtggcatttcatttccaaagctggctcaatacccacttaaaccataatctattgacatatatatgataaggaatgaaatatggtaaaagtacttgcaatgcttcaaatgcatattcataattcaagtaaaaggacagcagcctagcaaaacagaactcaaaaaatggggtccacatcacccagaatagtcacacaattatatacatgggcaactttctcataataggaacaatagcttttcttaggttctcaaagtggttgttcatgtatccaataaagaaaactgtgccacaaaaaaaccacctgcttcctacaaagccctcaggtagagtttatcagtgatataaggcatcttgatgggttatggtctacaaatgcatatagaaaataacttcataaatagaaaactgcacaaaaaccttccagagaaactaagtgaagatgatcctggagaaaagaacacatctcaaaatagatggggtgtgaagtgcccacataatatgacacataagttcatgtgcagtaggagctgatgatcccagtgacactcattgtcaaatagattttgaccaatcaatagtgtttgtacagctgacccagcttcagaagcaaacacaccaaatgtttatgtttccaagaggtaccacttaaaattctttcccatactagtcaaatcacaagggcaaaagtttacaacacttttgctaccattactttaaaaaggaaaatccatcttttatcaacataaaattcaaacaaacaaaaatgtctatttaaatgacccaaacatgtagtatgagtgaagataccttttttaataattgtgatcaagaaaatttggatttctttttatataatttttaatgtgacttgcaacttaacccaaaagtttctataactgatataacacagttcaaatattattcttttcttaaatgagagtttattgcttgtttgttttggggttttgtcataattaaatttgagctgcatagatcttaaggctgttttaataaatagtgtaatttcaaacttaagcctatctaaaatattattgtctacctgttcatctcaacacatgaatccacagctaagccattaaggtacatcatttcttttacctctcccaaaaccttatactttttaacacatgaggaactagtttgtttgtttttttttttgttgttgttgttttttaataggaatgcttttcacaagagagtgccacttacccctcctgccttcagcaactttctcctaaagtcctctgtggggttgttgaaagttagcttttcacagcggaggtgattcactggtggatggccttcaagatgcaggaataagtcataatcaaagcggactttcctaggttcttcctggaggttaacaaaaattatgaaagaaaaaagagagtgaggcataagtgaaattttaaaagcaaaaatttactcctcataagaaatagaaaagaactaagacatctaacagctaaactgtcaaagtagtactgggaaaaaaaaaagtatcatggaatcatcagtgaaacaaaatagaaatgtctgacaaattagtttcttgtgttaggggaaatgaaataagaaaaacttctcttcttccccatgatctttcaggtgacaggataccagcaacatagccacccaactagaaaccaagcacattccttcctcttccccaccccagtacactcaccatcaaaggctgccattttctccataaatatttcttcaacaagccctctaactcttactactaggcttttactcatggcccaaactataaactctctactttgggatatattctcttcaattcctcctccattcaggccttaagattatctatatgaaataaaaatctagccattttcacttcctagttaaaatttcaacagcttccaatagccattgggctaaaaatcctaatctcacttgaatgtcacataagggccttcataatctggctcttggcttcatattccaccattccccttctgtccatctgatggcctagcaacatcccattactggttgcttcccagtacctactgtgttctaggttacctctggtttcattcttgctttgcattactaccttcactgcctacctccatttctctacctactgctttacctagataacttctcaccattcctaactcaagatttcacttttggaaaacctccccttaactcccgactccccactgcctctcctctactatgtatgcatctttctctcacccttgccacgtcttagaataattgccttcttattatcaccatttaccctgctggatcagaagactgttgaaagtaggatcaatgtttgaatcatcattgtgccctcaaagactagtttatgcctatacacagtagaaatgcagtgagtatctgtgagattaataagaatggaatttttctgaataaataactaggacaaaatagcatcctatgcaaaagaatacaataattagaatttccgatacccaggttcaactctcaagctgttacttaagttgactgaacatttatccctctctacacattgatctttagccacgcaaggtgaaaatacagactcaagataataatgacatctcatttaattctcgctgctctctttggggcaggtgtgagccttgttttattgttatattactaataaatgatgaaacaaaataatttgaatccatttcttttgactcaagggtctttgcacctgaaactctccgaatataggaattaactactcaaaattcatggtttccacctcctcaccaaacttcccaaatcataatctccactcatttcctcagtaccccttcacttccactacaatctgacatgaaatctacttttcctctctcttatcaggatgccattctctcctggttttcctcatagtttactggctattccttctcaatcttcttcaaggactttcttctctttcttcactgaccttaaatgtcctttacctttctgcaaagtttcccaaggagatgacacccattcacaaggagtcagttccacctgtgtgacagtgactcccccaagtgtatctccaacccagctctcactgactgccatatacatgtgtccacaggttgacttacggcagcatccaattcatgcattatgttaaactaaagttaccttcatatgtgtcttttgtcctatcctctgttatcttggaatacagcaattctaactgcttgccaaggttaaattacacaaaaatcattcccaactgttacttcttcctcactcactacagtcaaattttctctaagttctatttagtattcgtccttatgaactttcagatctacctatcctttcctctaaggcctactgtcctagcttagaccaccaccattcttcatttgatgtcctccctgattttgaacttacctcattctacttcccacagtgaccagagagtgatctttctaacacaaaaatcagattacagctttccactgatataaaagcctttaatggttcatcattttctgcagtaaaatcccacttccttggaataaccattgcagtctcttactacctttcctatatttcttttgatttcttactatactgtttttccacaactttgaagcatctgcagttccccaatacttcacattaactcattcatttggcctttcacaagtagtgctccccacacctgaaatgtcctccctcccagcatagcttcccctctattgcctagttaatgcaaactcattattcaagacccagctaaagcattaattcctctgaaagtctttcttactctcccaatataatctgaattagatgtccctcatggcattcctctattaatgtaattatcacatttagttatgattttttatttatctgtctatcctctaagttataaaacagaagatgtaactttagaattaattttaaaaggagggcagttttctgccatgtaactgggagcataaactggtaaagcctttttggtagacatcttggcaatatctatcaacataccaaatatatataatgtttgacccagtaattctacctctaagaatctcttccatagaaatattcagatataagtacaaaaatatactattaaatgttcatggtagcattgcttagaatagcaagaaactaagaatgatcatcattaccacataacaccattcaggtgtttaaaaatactgactttgaaaggcatattgctaactgaattaaaggcaagtcacagaaaaatattaaatcatgcccctgccaatctctacgctgacacacattttatctatgcaaatacatggagggaaatctgggaagactgtaccaaatagtcaacaatcattaaatgtagtcaaaagactaaaactcctaagttctattccatatacttttactaggaaaatatatactcctatacactttcttaaagagaaaaacatattgaagaatacacattaattaccagcataaaaagaatgaggtaatatcaacatcactttatagtctacaacagtctaaaacagaacaaaaaacatcacttttcaataaaaccaatggtaagcaccacagaaaatgactctctgaatcctgagtatgatttttttaaagattttttttaagtaagaaaaaagtactcatcaacttgtgctctggccaactgaatatcttctcttagaaggcagacatcgacattatgtcagtctgtgctccttagaaaacattcttcttcaaagttcaaatgagaaagcatgtgcttgctctctatatataaataatacatttcctagaggtggaaatttgtttttggcaatatcaagttaccctctctcactctgcagaagcttcagtacttgacatttactctctcttttctgagatcagactgaaagaaagaagcctgcgatcctttcaaacataaattgattatgtttcagtgtccctgttggtttagagtttctgaaacacacaattctcacaaatagggttgttttgttgagcacaaatacaaaataagacagcattaacatatacaaactcaagagaagtactgacactctaccacccctcttgaccctgacagctcaaataaatgagcagaactgaagacgagctcattagagaagcaggaaaaacacaggatggggatgtgaccaaggacaggatatctttaatacgtggaattaagactcttccatcattacctggaattattttttctgctttccctcattcctgtgaaaactctgaacaacactttttcataaaccatttgatatggtttggctgtgcctccacccaaatctcatcttgaattgtggttcccataatccccacgtgtcttgggaggtaattagattatgggggtgttccctcatgctgttctcatgatagtaagtgagttctcacaagatctgatggttttataaggggcttttccccactttgcctgcatttttctctcctgccaccttgtgaagaaagacgtgtttgcttccccttctgctatgactgtaagtttcttgaggccttcccagccatgcagaactgtgagtcaattaaacctatttcctttataaattacccagtctcgggtattaataacaatgtgagaagggactaatatgccattactataatggatgtttattcttcaagacagagttgtataaactccagggataaataaaataataaatacgcaaaagaaagaaatgaacactctgaagcaagagcctagacctattaaatttttaccaatggatcatttcagtaacatgaaaaataaaaaatatatccagctggaccttggggaataagccagactcagaaagatgagtactgtctaagtccacttacatgagatatctaaaacagatatcatgtaagattttaaattcataaaatcagagactggaacggtggttaccatgggctggggagagaggaaaatgaattgtcaatcaataggcattaagtttcaattaagtaagatgaataagctctagagatctgctgtgcattgcaactatagtcaacaataaggtattgtacacttaatacacttaaaatttgttaagaaactatatctcacattaggtgctcttacaagttaaattagaaaaaataaagaaacaaatatacctagctcagagacctagatcagactatagcaaatatttggtttctaagacatcctaagaaaacaaaaaagtggcaaagcaataattccttttttaattaagaaattagtaacatatagaaaagtacttaaaaatgctatatccatgtgccttctactgagattaaacagataacacttccagagatatgctttatcttttaaagaaataaaatttggccagttggggtggctcacacctgtaatcctagcactttgggaggcagaggtgggcagatcacttgagcccaggagctcgaaatcatcctgggcaacatggtgaaaccctgtctctacaaaaattacaaaaattagccgggtccgtggtggtgcatgcctgtggtcccagctacttgggaagctgaggtggaaggatcacttgatctcaggaagtggaggctgcagtgagctgagactgcgccactgtactccagcctgggtgacagagtgaaaccccaccaaaacaaaacaaaaccaactttatatatgtaagcttcttcattcctctcctccagtaactaatgcccttaagttcctgtgttgtcattccaacatatgctcttatactaaatacatacctctccagaacaccattactcatttcaataatttctttaaaaaatacacaaatgatataaccatgcacatatatttctgcaacttttaagtcatcattttttgagatttactcatgttgccacattaagtactgtacagaattctatggattacataattaccatttattaatccacatctctacatagggccaattaggtgtatcctacttttctatattacaaacactgaaatatatatgtattattgtgtacatgtgaaaacagcaatcattattatgtatgaaattttaaagaaagcctaaaactagaaaatagaaataagctaatctatatactaaacagaaaatctacgatgttccaaatgtgtctattttataatggccacaaaggaagagatgtttttcatctcatatgctgctttcttcctttatattttaagaaaataaaatccctcacaaaatgaatatatgttttacagtcataatgactacccaatgtgccttcattatatcttgcttttactctgttccatgaatttcaagaagactgaagtgtgtgtgtgtgtgtgtgtgtgcacacgcatgcgtgtgtgtgcgtgcgcgtatggtagggagtgatacttgctgcctcttcatcctttacttgttttcttcttaaatctggcatatggggaaattccagttatttttgtaaagcaggaaactgagcaattcataaaacagattcctctgttcaactccgagcttgtacaaatgaccagaagagttaaaaacaagaaaagagagaagatacttcattgcatcattatttcaaaactgaagtcaatgcaatgtcaaactaactttgctggtgggaagacagtgatataatcataaccattatggtcttctcataagagatcataattgcctattctttaatttctttgagttaagaactttgctggcttgaagggctagattattcctatggtgtagcccgatccctagatgaaattaaaacactggctatgaggatgtgacaagagggaagaaaagcaccatatgatcttcatcacttaaacttctaagatattaaaagggtagtggggaatatgggagatagagacaggctctaaattccttcccacaaacataccacttaaattaaaaatacactgaaaagtgagcaaaatgagatatgaacagtcacttctccaaaaaaaatacaaatgaacaacgagcacatgaaaagatgttcaaactcataaatcatcaaagaaatgcacataaaaccaaaatgaggtatacttcacatctactaggatgactataatagaaaataacaagtaacaagtattggagaaattggtagtgaaggaaaaacagaagaaataaaagaaagccaaaaaccattttcttaagggaaattgaacttgaaatgagaaaaatgagcacttcaatatgaaagtatatcacgtcaacagacataaatacatctcgacaaatttgatttgatgacaaatatgtcaacgattcagtggtatcaccactaagaaagataatcattattctagcaaagagttgttgctagaaggcacagaaattaggagcatagccaatggagagaaagacctagatcacgaatctggttttaacactttctaactgctgaattgaggactgagactgctataagttaaaaaggccagtgtgacactgttccagtggaagggattgcacattaaggagtggcttatcagtggttctcttacttactgagcatcagaaggactagcaaatatgcagattcctaggccctgcctccagagattctgatttgatacatctgggtagaatttgagaatctcatttctaacctgcccttagggtaatgctaatgctatccaaagaaccatattttactgagcactggtttggataacatgacattctatttgcgtagttccttaaaagaaaaaaaaagccaattacctgacttttcagcaggttttagaaattatgatatctctggaggaaaaataaggaatatgatataataattagcattttgaagtgcttatctataagttactattctaagtactttgcataagtttattttatctaatcctactaaccaccttatgaggtaagtactcttatctcctcatttcataaataaggaaagtaagccccacagaggttgaccaatttgtctggtattatacagtctgtgtgttatgccacatatgtactgctaaaaacttttttttttttttttttttttgagaaaaataatggagcctcactctgtcacccaggctggaatgcagtagtgcgatctcggctcactgccatctccgtctcccaggttcaagtgattctcttgcctcagcctcctatgtagctgtaattacaggcatccaccaccatactcggctaatttttgtatttttagtagagacgaggtttcaccatgttggccaggctggtctcgaactcctgacctcaagtgatccgcccgcctcggcctcccaaagtgctgggattacaggtgtgagccaccgcgccaggcctgaaaacttttaaatccagtaaaatccatatatctgaagttgaaataactatatacatgtatggtgtgggtaccagctaaagataaaatgagagtattctttgcaagcctcaaaaaaattctacagacatgaaaatgagaaaagaagcattttactgaaaaactataattcttcttttctattttacaaacatatttatcttttccaaaatggtaatcactcctctctttaaaggaacacttaatgaatttcacataatctgacttcatataattaaaattatcttcttctagccacttccttgataattaagggtaatgatagccaaaattcctagaagacaaatttaacttttattttaaaatcatctagtgacagaagtgcttatgagtcaaaattattttaaacatcatttggctaatggtggatcgtctactgaaagattaatgggtaaagattacataccttgtttttaaaataaacttcaattggcaaaatgaaaccagcatacccagattcttctactttgtaaggtggatctttgcacactgcaacattaaaaaagaaaataggtaagatgagaataatagacaaaaagacattcttcttttaaaaaaaaaaatcccattctaccatctagatcacacgcaattttcatagccccttgccaaactcccagttgagtctccgatctatcctttatttcttctccagaaactataacaataattgctcttatgtaaagcagatatgtaagtcatttattcaaatcttggtggagaatagctcatcacagtcaaccatgattattaatgagtgaacttcacttgttattaccctgcccaaaagctttagggaaactgatgattgctccctatgacccaaagtttgaaaagaactgtaagcttcctaacaagagtattatctgcatctagtctttgatgcaaatcactccccaccttaacttctgacttgtctgagatgtcctgacaaggacatctttttttttttttttttttttttttttgagacggagtttcactcttgttgcccaggctggagtgcaatggtgtgatcttggctcaccacaacctccgcctccctggttcaagcaattctcctgcctcagcctcccgagttagctgggattacaggcatgcgtcaccacaccaggctaattttgtatttttagtagagatggggtttctccatgttggtcatgctggtcttgaactcccgacctcaggtgatctgtccgcctcagcctcccaaagtgtagggattacaggcatgacccaccatgcctggcctagagatgtcctgacttctatgccatcctctttccttagaaaatcccaaacccagagtttctcaatgatgcataacctccctccttcacccacccaaaaggaatgtttactaaaataccaatatacatgtaaacacttaagatctaatcacatcataagaatacataagaaacaataaggcttttatttctcatggagttaaaaggaagcaagactattaggcaagctcttggggaatgagagaccctaagaagccaaacaggatttcattccactaaaatttcaattaaacgaaaatcagtcacaagccaactgaaaccattctagttaagactgcattttggtggtatcacaaagtaaacatgtacatgccaaatatcaaggccacacacactgatgccctgagtcctcttcagcagccccagtttacctgtccttttgtcacctaccaaaacccctctgcttcattccaatgcatttcccccaaatgtgcccagcatttcccaccagtgcctggtcctccttctatcccttccaccacaccttgaagctactcttagtatcctctgcaagttcaaattctactttcttcacaagatctttctagaccacaaagcattaccatctcttttccttttatcctcccaaaaagttaactgcctgaatcagtaccttgacactgaacagagttccttatgaccatattttgaaggatcttgtctgctaatttcctttcacttctcaaggacaggaagcacattcacctcaagaagatagagtgtcaagggctcaggcgacagcagcccagaatacttgggtaccaatccatgatcctcctcagactaggcgagctacctctgcaaaattatttcatcttagatctctgggttcctcttctagacaatctgaagactaaacaaggtgaccgttacgaactgaatgtttgtattcccctaaacctcgtaaactgaaatcctatcaggaggtaggaacttttgaaggtgattaggtcatgaaggtggaaacctcatgaatgggattagcaccctagagagctctcttgccccttcctctatgtgaggacatggtgagaagatagcagtctgcaactctgaggagggcccccaccagaatcccaccatgctggcactctgatctgggactttcagtctccagaactgtgagaaatccatttgtgttgtttataagccatccagtggatggtactttgttaaagcatcctgaatgggtaagcacagtgatgtgtgtaaaagatgcagcacagggcctggcgcataagttctcagtaagtgactgaagccagggaggaaatctaaacataaaacacccaattgccatgtagccttttggatgaaaataaacaggatgcagcaagcaagagccctagatttgggtcagaagactcaggtccacagccctggattgaatattctctagacagcctacattttctctccctttaaagaagaggaaacaccatctacacaactgaaggcacagccatcgacatacaaggagactatatgtaaggaaacagaagcgcgaggcatttttattacagaaatgatgttgataatgtacctggaaattggttagacattccacaagcagaaatatggttacaaaaaggtaaactgaagcccaccttaggaaaattgccccaaactgacatccgaagaagtaaatcaagaatgagacatctcacatgaccttataagtttctctaatagaaaaacgaaaacgtgaaaagatccagagtggcttcagtcttgcattcactgaccacctgtcaaccgatcatgaatattcaaatattgtgaacactggagacaagtgagagagtctcactaaacgcattgagcagcccccaccccaccttagcaagaaggctagtgttacgcttatgacacttccaggctgcaaagccccttttcagaacagcaatttcagtgtcaggttgcttgggattaatcatgccaatgtcattggaaggtagtttattttgtgggctgctgcacatgccagagaagttatacctgatcctctatataccctttagtataattcattttctctattctgaatgcaaattgctcctattaacagaaacagctgttaatgagcacatcttatcgttgaatatctttggatttttttttccccaccctttaaaggaaatgacttgctacgtactaatattgtatagaagtgtgattttataagaaactgtttaccaattcatataattatttttaaatgcaacaatttcatcaataacaatgaacaatgtctgtaaacccctgagttcttaattagaagcaaacaacaggaactttttacacacaataaacaggctagaaaatcagtagccatgtaaataaaaaacttacagttctaatctgaagaaagtcaaattaggggaagttgtttatttatttgggtattttatgatcagaattagtatgagtttcttagttcaaaagaaacagaggttaaaacttagaaacattttagccagtagggatactacattagatataaagcaattcttttttaaacaagtagaaccatgtttgggagggatcaccttctgtcacttgcaacacttcttcattgagagtctcttctctcactgcatcaagtttatgatagctaagcattctaaaccctgaaactaattcttcctcttgattgttcaagaatcagatcatccttaagctctatgtcataaaaggccaagtttcagaagctactgaatgaatattcacctttagaaagccattaaaatctttaggtgacaataaaatgggataattaacatttactttttaaattctcatgttctattatatgcatatgcattctcacatattaattcaggcaaaatcattaaaagcttttttcatctgtaaatatccagcccagatgttagctctttcagaacatctcccttggctctcttccataatcttgttgcaatgaacaggtcagaaggtaagtcatttccctctcagactcctccactagacagacccccttcaaagtcagcaaccacaataattattcatctttgcaaggcctgacactaccattgagccaaataatatgtacccaacaaatgtttgtcaaatttaacttttaaaagactcatgctacccttcactgatttaccactgccaaagaagttgtttttccaaaagaagtggtgagttgacagtaacccatcaaattcttctccaaactcgctacaatcaacataaacttttaaagcttttaaaaaattggcacaggtgatagaaaagtgttgccacagaggaaatttttcttgagtactgtggaactggtcctagttctgagagcaccacatgttaagcaattgagttaatcaactgggccagaagatctctaaggccattttgaaactaatattcaacagccgtaaataaccgctccccttctcctctccatccacacattactacccatgtactccaagactctaattgggagaggttttcaaaactctctttgtctaattaatcccatgtaccatgtaaggtctattaggatactataatgaaaattcatgcctgagagaaacagaccaaagtttttgtttgtttaaaaagaagtgtaattgggtttaattgcatttttccctgaaatgtcttttcaaaataacagacacaatatagattcaaatatataatatgtagtatgatgctaaccatacattgaccaataacctatttaatttttagttggaaaacatgtacacaaggaagaaaaacacatggaaagggggaaaagaaaatgatctggcaaatttgcaataagcaaggacttttaattagttagaaataagtcaaacccttacttattaaaagtccttactgaaaattttaatattctcgtttagaagtaaaagatttgacgaagagctatgcttggtacagagaaataaatgctctgtaaatgaataaatatatttgtgcttatataataaattacttatatatattcaataaataaatgtaattaataggaactatttttttagcaccaaaagaaaaaacgctgccaactccataagaccttcatttaaactttagaagtattattaggcaacagttttttcccgaaacctcaggaaaacagctggtagattcctctccagagcatccctttaccctatttgttttgatgctatgatttatggccatctgaatacttttgttaagaacatggcccagttgcccattgataattattggctttactttatttactgtgcagagagcccttcaggaaggaaacacatcaaactctctctatatatagactggttattactactgctttgtgccaaatgtcccttccagctttagtattttggactccctcacttcctgcttcacttctaccacatcagagcctccaggaatggggcaaacaagatcctgttcagcccatctctccgcacccaaactgttctgcacaagcatctggaagtctagagccagcgtctgaaagtctgagcatcagagggtagcttaccgcacctaccactacaaggctttacagtcaagacattttgaaaacaaaaatcaacagttgagttttgtttttatttttaaaagcacacacaaaaagattcaccattgattttattcatcccacttcaaaacagattattcctaaagaacaaaattttaaaaagttttccctcttttgtgttttatttcctccatttccttgaacaagaattaaagataacatcaacaaatacattgagttgtatgttgagttgttctcaccttttggatcttttaaaaaattcaaatgcaattctaaaaacctaattgcttcctatacaataaggaactgtagccacccaatataactgtctaattaacgttcataaagttttaaagacacaaactagatacagttagcggagaagatgcagaccacctgtccacctcctctggactcaccactcaaggcctgactcaatagcaccacctctggagagccttctgccaatactcaaaacaaaaaatggtcatttctctcttctacctttttctcattgcatcatattagctaatcctaatacatctgctaccatcaagtcccatcctcatccctacttaattcagagctttccaaaagctaatgctgtttcccacacctcctctcgttccttatcccagaccatcatttatgaaattgagtaaatttgtgaaacataactttagcatgagttttaaaagaagggatagagtaagactgacagttgaggataaagtatacaaggcctgggcagcaagcagaaagtgtgaacaaaggcatcaggagagtaaaattcaatataatgagacagtcggtataagcagaaacactgaaaacaatgaaacaacagacaatacaaataaagtttacatttgtatagagaacgtcatgctacacacactcagaaattcatgtcaaaagtccatgaggggaaaaatggattgcactcgtaaaggagggattattgaatttgaaatgttacagagaacccctagatttggaataagaatttgagactccaaattggctatattgcaaaaatcttaatgatgatacataaaaattacttcacttgttagtaacttggaatgtttacttatgtattcagtatatccctggcttctctttcaagggggtgggggggaggagaaattttctttaacatacgcacaacattttcagctttctaaggagtttagtcattagagttagcaaagcccatgtagctgaggttaagtcaatacatttcatcttgagggaatataacagctatgttaaaacaggactgctttcacaatcatttcttcaaggaacgtataacaaataagccagcaaaattcagaagtttcccaaaactaggtaatattattaattgctaggaaatactaaatataatttctcaggcttacatctttcactaaaattgatagtgcttctcctagcaacttcccccaagttccttcaatgtaactcagtatacagaattgtttcaaatgattagcctagtggacacagatgtccaggctaatatgatgggaaatagaaaaactgtatcttcagagaaggttcaacctagaaacagacctaattttttattgaaaataatacaaatggaaaaatcttgagacttgtattccaagaattattatcattttcttaaagttaaaccttgggcaaaatattcatatttcagaaagtccatctggaaaagcaacactagctacacagaaaatgatcttctaggaaagtaactaagaactgttcccatatttggtgggaacattttcatttcagtgtgtactactacatcataaaagttggtcatctgaaaccccagttcttcttggtggctttttaaaataaaatatataaaaaaccattgaagagtatcacttcctaaaacaatcgccttttgatttctgtaggtagcagaaaaaacaaaccttgggacagccctctggcatcaaaattttacccaggcttccatgtactacttctggccgagccattgctaaaactggaactgttttttatttagaaaaaaaaaaagaattttaatgtgttaatttataaaattatacttttcattaatattaacgcatttcttctcaataataatagccaaattaattaaattcaacaagcactacaaaatcttaaggctacaaagataagacgagtcctgctcagtctaaccagagaccgttgcctgctaagtacaagttctattctagggactgtggatagagcaataaacgtaattgacaggtcccctgcacttaataaacttatatccactgttgggagacaaagggaggaagtggagagaaagacaacatgcatatataaaatactgagaaagtactgagtgacaagtgctacataaaaataacagtatagaataataaaagtgttatgataataaaacagacttaaagaataggagctcttttttattttagaatcatagtccctctttaaggaagtggcatttaagttgagacctgaaagaaagaaaaaaagcggggagggtatgtgttggcctggcaggaaaaaatgacatttatattggttacagaggaagatgtgcaaacaatctaaagcctgtccttatattcacctccagcactacttagccccttacctgatttcttcctgtataactgaggtgaaagccatttcttccttcctaaacatttcctacttgggcttctcttccatgaattcaccatgtaataacccacacaggtctggctcttataatttcatgataatctcgtttctcatatcttaaattctcctaaagctataaacccccaagagcttataatgactctacattataaagattttataagtagacataattcttgggaatttatataacctattttttctttttcaatctgtcccttgaaatttcagagttcctaaacacaatgaatgtggactaaggaataccaaagcataaaaaagcagcagattttgagtgcaatttaagaaaaggaaagataacaggtgaaaagctatctacacaagggagggaaatagtgttgcaggaaaaaaattacatggttcaggagagaaaggggaaaagtacaaaaagagataatgttcaaattattaatatacagtagttctaattttctcaaacgtatattcaccttaaaaggataattttcaactgaaatagatgggtgttgttcttttaataaatgcactgtatgagagttacttttaaatacgctacacccatattctcttacctaacatgaaatttcattttttattctgaccctttttctccaaatgcagaggacaacaaaattgtgttacacacaacagttatcaattgcatagggtgatagaaatggcaatgtgttataaaataatcaaatataataaatcaaaattaaaacccatttctgagttttaaaaaatagcctaggagaccatcagaacctaactcgacagaaacaccaaaacgtgatggctcaatattaatttttgctttattcccttttccaggacaggatccaaaattgtcctaacttcagaggaaggattaagaacaagatttcttttcagcatcttgtgagctctacttctttttcccccctgcatggcatttggcatagtggtagcctatcctaaatatcctaattgatttaaactccattaaacattaaaaacaaagactgaatgagggtgatgttaatatgatgacgacagtttatacagggtacatataggagtacagtttctgtttaggctgacaatctttcaatcttcttcaagaaaccagggaaaatccagtttctccacttttctcaagcaaggatttccaaactgtgttccaggaaaccctacatccttgcaagctgtttaagtgattctacaaaaagggtatttgtcccaaacaatgaaaaactgaacagtggaaggactcatcctagttttagatacaggttgaatatctcctatccaaaatgcttgggatcagaggttgattttggattttagattttttaggattttggaatatttgcctatacttaaggttcagattttaaatccaaaaatcccaatccaaaatgctccagtgattatttcctttgagtgtcatattggcattcaaaagtttcagatttttgagccattttggatttccgattttcaagttagggagacttaacctgcacagtgttagtgtccccttaacattatgtgaaaaaaagccatggctaaaacaaaatctgaaaccactgttcaaacgcatttacattatgaagttttagctatatcatttaagtaaacctacttttacagagtatggggtttttttgcttgctcctatcaaacatagtatcagtttactgttttctccctaccctgactatagaagtgagaaacacacagatctctcaggtttgtaactctggcatgtctttgggctaaatagataacaggataaagaacagcttttattcaactctgcaggtcaacttttacaaaataccttctgattatcaaatgtggtactaattgcatagtatctctcatggtctctgaattgcaggaattactaagtagggggacaaatataagagcacaaacataaatgaaagagaaatcaaaacaaacataaaaactactagtagtcagtgttataggaggttgctcacaaactgaaatgcttagggaacaaaccagggagaagcagagacagagtcagtcactggggcttaatattagtttgttttaaaggaagcaggtatgactgtcaaaaggaagaagaaaataaaattctaatgagcagtaatgattctagaaaagcttggtataagtaggttataatacaagctagagtatatatgaaacattccacagtagagcaactgaattaggtatttcttaacagttcttttcaaactagagacactatgaaaataagagggaggttaaaaaacaaaaagagagagagaaccggatattggcaaagagtttttttttttcaattgagacaagctctcactatgttgtctaggttggacttgaactcctggcgtcaagtgatcctctcgcctcagcctatcaactagctgggactacaggctgcaccaccatgccctgcttaagattttaaaagttcaggccaggctcagtgactcatgcctgtaatcccagcactttgggaggctgaggtaggtggatcacgaggtcaagagaaggagaacatcctggccaacatggtgaaaccccgtctctactaaaaatacaaaaattagctgggtgtggtggcacgcgcctgtagtcccagctactcaggaggctgacgcaggagaatcgcttgaactcgggaggcggaggctgctgtgagccgagatcatgccattgcactccagcctggcgacagagtggcactccatctcaaaaaataaaataacaaaataaaaaataaaagtcgatgagcagatttaatcttatttaggagtaataaaaaatcgctattttgagaatagaagcaaaggtaaccaaataatgcgcaaagcatattgcctattgccccaaataaacaaagagaacagagaatacagaaaatgaagactaaatacgaagaaagaggaggaaaaaggaggctgaaggttaagatgctgtcagaaattatgactgtacctcaaatacaaaagtaggaattatcatgtatgctgctgaagcttactgtaataattggcaggtgttttcctcacttaaatcaagggctcattgaaaactttaatttagcaacaggcagcattttgcggaagaggcaggtatgtataacgtggagacagagaagtttagtggtcgagagccagagcctttgagaaagatccttaggttcagatcccatcttggacatattatgttcagttccctcatttacaaagtgaagctaatgctattgcctacttcatatagctcctataaactgtaagaggttatccatgctagaaagcatgagatagtcccttaacttttaaaacactttctgaaaactagaaatcactcagttatctaatagtagtcaaatgcaagccataaatattagagaattttttggacttcttcccccaaacagtgaaatacatatatttgccatcagtataattaaatattcctaaatttgtttttatttttgctgtcatagctccttgacagggatatgtgaaaaaagaaaatgttcctcacttggagttcttttagctcaatccaccactaaaggtactattagcagtgaggccacactaatcagcccacctagaaactcgtgaagcccaagtgagcacatattgtgaaaaagctttaagtaaggcttccgaggttatgtactaaagcaggaacactgaaatactgcaataaacaaatgagtagaaaatggaaatgtaatctgagtttgagtcctgtgatgcagtaaaagaaaaattaatggggaatcaggggacctggttctggctccatttctatcacaaactagccatttgtcctttaaccacttactctagccctcctctgtcacataagaagccagcttccatttcagaggctgcttccacatctaaaatcctaacattcaaaggaccgacgtcatatatgttacttctactctaacttgaaagcaaatgcattttttcattatctttgtttaagcataaaacatttatcagctaaacaccacatctgctgttaacacgatcaggaaactgagacaaaacaagcaaacaaacaacaaaaacgaagggatttaaaatcacacttgaattgttttaaatatatttggtaaagccatttttcttaaagagagaacaactatattttttattagaccattaaataaaggaatactaaataaaacaggaaatactaaatataaaggaatactaaatattgcccccgtgcaataaaaaataaattagattttcattgtttccattcttacttgggagtcaccttaaatgtgtcaagtaaaaccctgttttacatgtataaatcaaaccagcaatttgattcctcaggaacttggtataatttagttagagtggcatatgaactccagtattaagaaatgaaacaacagaacatacctggcagcatttatgagaaatatcatgcctttaaaatggtaaaatagaaaattaaatcaactgtttgcacattaggcatagcacgttatgtaaaaagctcttgaatgttatgatttttctatatattgcacttgtaacacccttgttcttaatcacattgaagcatattacattgctttttaaatagaatgcaccctgccactatgcagtcaatcttaatagtattccagaacagcgtgcccatatgaaagataggttgatgaataggtttatgccctattcaaggagatgaaacagctcaatagaaagattaaggcttctgccagtagttgaatcttaaagtcaaagagaagaacacaactcaaaccaaatgttacagacaaaggtcaaacaagagaataactgagagcctaacttgaagaactagctagtgttcactaattcggtgcaatcaggaaaaaaaaaaaaaaaatctctcttcctaaagagtgaccataataactttcactgagtctgttttaaaagataaattataaaactgaatgaaggtgagctaagtcccaaataatattcacagggaaccattcctattttgaatcgactggaacttaggtacaacacagattaaaatcttgctgtcatattgtaatttaaaaataaattctagaactataaaatgtcaaatattaacagaagtatgaattttggtaaaagccttccagttaattttgtgtagaattctattatagtctaatttatttatataaaaagaaaagaaattttatgaagaaaaaaacagcaatttgtttcccaagtattattttttgttgacttgaatgtccagtcaccagtttcaatctcttctaacagggtatttaactaaaagatgaacatatacttctcactgtgtacacatactaccttcaaaatggaaatacaaacttggctctaggaaaatgtggaaagtatagaatagtgctaaaagaatagaaaaaaatgtttatcacgttagtagcaaatatttgggaggcattataatcccatcttgagaagcctggtttatttaaatttctcatcagacaacaggttcatttgtgttttattaaaaaaaattgctctccctgtgtgttgtcatttcgtatgttgaaaacccactatctaatttaattttccctcctaaatagcaacgtttttggacaatgatgctgatatcagctaatgaactaagtaaatcatgtgaattagtatacctatgtcaatgccatgcccaggagtaaatacaatcaaccagaaagactaccaagaaactgaataagctttacctaccttatcaattccttttccttgtttttctgttttcatcaagaaatgctggtagataaattccaaatccatctgactctagtttcttcctgggatgtcaagtactattgtttagcttctaccctaaaccaaaggtacaaaggagggtagggagggagtaataaactgaacaatagtacttaacaccacaggaagaaaattttaatattttaaaatgatgctttatgtataaatacatgcatttgctctcacacatacccccttctaaataaacacatatcaaacattgcaaataagtcattttctttcctacttgcaacaaaaagcagtgagacatttaaagacagccaatttcaaataatttcttccttggagataacaataaaggtatgatttatttaacacctttcatcacgtccctgaaagatcactgatgtcacataaatctataacataaggaaataagtagctcaagagctctgccagccacccttttttaaagatggaatatgacaacttaagcaatttactcagaggtcagtgagttaattcctagcattcaatcaatagatatttattaaaggcttctgtgtagcactttgtgctggatgcttatatgaaaagtatttttttctttttgcttatttggatcttctcatttttctacaaaaacaaaaattattacttgtaataataagaaaaatctttaaaacagtaatgcgatgttgagtgaaattaagaggaattcggagaaatgcaaggtctctggaatttgaaatattcagaaagtcaaggaggactgaggtctaggtcttccacctatgcgtactttccattctacaccttttcctatgaaaatcacacaagaaacaagtttataaagataccagatttagagccagctaaactgtgttctttgctgctctgacatttcctagctgtagtaattaactttaggtaggttatttaacttctctctatctcagattctcctatccataaaacaatgaaagcatggctgtgcaaattcaatgtaacacattattttatgagaaacttgatttgtaaatgctaaatgcctgccaaacattcgtcttaaaacatattttgccaacagttacgcttacttccactaaatggggacaaagagaaggtgccactgagccaaaacttctgactaaccaagagataggtgttagaaatactgagacataattctgcccctaaggatgtcacctaccattttttttttttttggatagaaaactctagtaggatgtggataatacacttttaccaccaacacagcaacacagctgtttcttagctaagaaatagcaaggaaaatgaagatcctaaaagaatatattattagaatagcataatactgttaaactgttaaggtgaaataaatgacataaatttggaagttcttttacaaatatggtttacttgaacttcatgttttagtttaatgctcttattatctctccatggctttaattctagcttcatttagataatgtgttatagctatcaaaatatgtttttagggatttgtttttatgttaaaacccagatattatttaatcctattaggattttcatttgccttaaatttactgacataacagaaactatattaataaactagtatgcaaatttttcaagttaccatgtatttcctgggataggtttatattctgagatggttccaaccctcaatgccactgccatcacctattttcaacatatgtgttgccggccattcacttattcctttcccaaacatcgcacatttattatacaccaggactaagaatgcaagcatgaatgaaataagggcttatcctcaaaaggatcatagttaggcattttctgtccaagcattttagatcccagttaagaatttcaagtactgcccacccctaccactgggggttgggcattaaacaagtgaaggtgccaagtctttagcagcagtagttgaacaccctagattgaacaaacttcagatgggcttaaaccaactataaagaaaaatatatataagcccctgcatgtttttgaagaaacagttcttgttaacaaccaaagaaaaagcttttcataagctataagtgctaatacaaataccaagcaaaccaaatttagaaatatcttaacttctaaaccatatcctttctttaatcatattagttcagcaatgtaattgcaattcaatcctctcctagtcattcaaaagttggccacactcccaaagaaacttcaactgctattctttccatttatttctttttactagcactatgctaacaaaaaaaaaaaagaaaagaaagtttcttagctaagagtccattagtttaattacacctagaacagtggtctcaggatcagtaacaccagcatcacctgaaagactttttagaaataccagtttttggtctctactctagatctcttaaatcagaaactctggggtagtccgtagcaatctgttctcctaaatcttccaggagattccgatgcttgctcaagtttgacatccactgcactagagatcttctcatatactcacgtagtcaaagcaaagatgttttctctttgcaaatcactttttcttattgcttcagttacactgctattttttcgtccaccaaatggttaaagttacttctctcatctgaataattacatcgttttctaaaacacttttttaaaggagcatgatgtacaatcatcccctaaaaatttccttttctgtataacattattttaataatacaaaaattgttaataatgttgagtttcaccaaatgtaattttaaaaacaaagaacaacaacaaaataaaatgttcaagagtaaaattatgatccttaatgtgataacaacactagaggtacgtctgtttactgttcaagcaatcactgccaggaagacatagacacagtcagggaaggaattttctaaacatcagaggctaaacaacagttgcttttcattggttggtaaagaataggactgggtccaatattcaagcttaatccaccagataatactcaaacatttcccataagaactgtcaagaacatagtaatctcataatgtcactgctatgaaaaccatttaaaaaaaagcaaaagacaacaaaaaaactaactatgctaataaactaaaaaaacaaagtagctgcagactgcttcacaataatggactcaaagcctggctcatatacaacaatgaagtacaatacataaataattattatgcaacttgtaaattactactgtactttctagtcactgcacaaatagaatttattctaccacactcttgcttcatgtctgttcctagaaggccagagttgatgcccaatagaagtatcaaatgcctacagacttggaataaagttgattcccttaaacgatgataatataaccagcctctcgatactcaggacactgaccttgctgcagctgcttttgatttccaagtgtcggctgggagtgtctttttcggtctcttggctcctaaacttatgatttatctttctgaagccctcgacaccatttctataacactctaattattggactgatttgaacaaaagattcttcagtaattttggcttaaaaccacatagaaatttttataataagaaatgtgtaaagaaaattggagaagatttgaagtgatgaaagagtttatatctgttatgatctaaacagaacaccctggaaattagcttgtgtagatattaatgttcaaatgcaactatgaatacttacattttcaatgactagctgacccacaattaatattcattatgtgaagccaattactctcaaggtattgctgttaatataaatggacctaccctatcttgtcattctgttcctatacacgagtctcctcatccatatactacaaggctcggtctaccaccaaaagactctgccttcattcggcggagaccctgagagacacccttgtattccatcctaatttgttttttcccacatacagccccctctctgatctagctatttgcttaagaaaatagtgccctataagcagtttgaccaacgaggggaaaaaaaagcagaccaaagggcatcctatgactataatgtaatgagggcaattttctcccacagctactaagctggttttgaagacagcatccacagaaagcacttgaaagaaacacactcttttgcaaaaaatatgttttaatatatctattccaaatctcatcaagacttgaatatttttaaatagctaacaggtaaaagggagtagtgttctaaatattggaggactttattacatatgtccacatccaggagtaaactagagtaacttaatgctatgaatccaacaaagagctgtcagcctagtacaccaacccatcaagccaaagctttaaggctacttgacactataaagtaatggcatgagaaatggccggggggtgggaactgaatgaatgaatgaaaaatccattggcttaagagttgattcatgcattttaaaggtcagtgtgatttatacaactttaaaggctcaaggtgaagttatttgtgatgggatggcagctctagtaggaaactcaaatacagcagaaatgtcagccacttgactgttaacgactgtgctttctgcagtaaatttctacaatgtgaaagagggtagccaaacaggtatctctcaataattcacctaaaaagacttatcccatcccctaactcttaacaacttttcacaaagatacccatcaaatctcccctcttggaagctgtcctgcactttatcttaatggtataatttcaaattctgatctgctgcatgaaaaagaaggcataaatcagcttcagttaagaaatatttaaaattttgttaacatataaagtttcatacaactgtctactattaggcagctgtattgaaataagtcatgtatatatgaaggacaattcaacaggatcagaaatatattatttatagctgattaaatatggtatttggtgcatttgtttaaaacaaaacaaaacctggttcaggtccccgggtcaggaatggaagctcctcattctcacattggttttatgggaaaaatcacatttgacttccattacactgatttacattacctagctataccaggatttggcacaatttaaatacaagagctttttacacaccaaagttgagtcctcctccaaaatacacacaatatttcatttcaataggttgaagggagaatatcagtaaagctattggtcagtgtgttatttcagttagcaacaaaattgtcctactgaaacaaactatgcgtttcactgatacatgtttttctaaatagcaaatatgataatgctacctaaaagttttcccagttattccaaacttatttatttgattcaaaaacaggaaaattattgtctcaacattaatgcgctgttttttttgtgtatttttttttaagagatagggtcacattctgtcacccaggctggagtgcagtcacgcaatcatagttcacagtaaacctcaaactctatttggtgaagatatttctagataaaatgccatgtgataaatatggttaatgaaacaggaggagaaatagtacttgagcaatgcatacactcttcagattttgtgccatcttcctacaagactcaaagcaggtcagcaggtttgttttttaagcaagttagagtgacccaaatcagagaaatacttgtatacagagaccctgagacagcaacttcactttaatcgggagttaaatatactgtctaacaaaggtatctcatagatttcagcatgccttatccacatgttccctgttcattacagtgtgtaaatttaagttatatcagtcacttgtaaaatactgccaaaaaatttatatccttaaaacaaataagtaatgtcaacttaattcaaaaataaatggtaatacatacaattataaatcagaaaccaaacaaaagcttataaaattacaccagaggctctataaatcatatggtacctggttgagattccttggaaatgccaatgaaaaccaaccttctaaggatttaaaatgaaaaactttttacatttgaagacagtattttatcttgaatcccttgaagtccatcttaagtggagtattcatcctaaagactgacattttcattgaattctcaatattaaatagaaattgttaagaatgattacaatctagaaaattatcaactagctaaaatgtcctgatttaaatttatatcaataaccatagcatacgttaaggaatctatcctttaaaacaaacaagtcttttccatctgtgaataaaggccaggctttaaaacctatggtcttttgttttttccaccatgctataaacatgctataaatagtttgacagacagtttcacctttaattgaaccaactctgactagaacagggatacggacttttgtctcctcccttctctggggcccagtgggatgaatgtcggagggattccacacaagctttagatgtcttggacttagaccctatttgttttggaaccatgggttcctttcttattaaattcttctatttgccaggagaaaactggaacaaaaatgaaaaagtgttgactttaaggtttgctctatttgtcatgattggaaatttcaaggctcttttttctttctttgtaaggcaacacactctacaagttgcttatgccctttgttttttaaagtagtattttagagagaggagtgaaacaactggagtctctgttttataatggcatttgactaacaaactctgatgcagcctctctcacatccccaactaaaaatctttgaaagtagaccccaataagttaaaacaaactctgccacctaaaactgaagctgacaacctatcacctttatgtgagcttactgtcctaatgaccagaaggatgacaaaactggatagggaaaattttaaattaataaataaataaatagccctcctctcctatatgctctggggcccaggaagagtcacacaacttctccctgggacttagtttcttctataaaataaaggctagagctagtgacctttctggctctacagttctcctatactccagggagatacagagagggtgcacagtattatcaacctaatcccaatggtatgagttatttttgcaagctcacttctaccctaaaatgagatgaccaacactgctataaaagcaacaaagaaagtcctaaagagaaggaaatattttctacgactgtatgtttcacagattaaccaatactggatttaacaatttaggatttcatttttaattaggttgcagaagaagcgctgttccagcctttgcaacttcatcctctatttacagctgccaaagtaaaaagtacaataattatcagaggtggatcaagagaaacaaagccaccttgaaataacaagtcccctaaaccctgccctggggcttagtgtcgctgtgtttcaggcatgacaagaacttgggtagatcctttgcaactgcttggtgatcacagattctcggtggactggcagtggctgcactgagaagctgcatcttattcctctacctctgcagtctcttctcagatatgttaattgaagttaacacggcattctttgcatacactaaggcctttataaacatttctggctttcactaaagagctacagtgaggagaagagatgtaagttctgtgaaaagagttgttctgtcttgtttagcactgtccctcagtgactaaaacaatacctggcacagaagagatgctcactaaccacagacggactgactaacatgcctcttgaaagtaagccagaaatataacatagaacatggctggtgaactgcagagtgagacactgtgccccgtcaaggaacaactcaaccaactgatcgtagtcttataaagccctaaaagcctaggttcaaagatgacctcagatatctcttgctctgcacatgatcactatagttaagatggaagatatagctatggcaaggtgaaaagagcacaggaccgtgaataagatgacctggtttaaattctaaatccactccttaatagctatgacccggggcaagtcattttaacctcggagctttcctcgtgtttaacaagggagttctacttcatagtctagttggatttagaaaagaggccatgtataagaaatcacctggagggaaggagagaaggagaggaaggggagaaagggagggaacttcagcagaggtgaagttccatctccagaaacttcaacacggaattttccatagagggcctggtgtacaatagcagctgtgggaatgctcttgagagactttacaaagaatgagattgacaggaactgatgacagtttggatttgaaggctctcaattaaagagatcttggtctgccctcatctggcagggcctgaattccttctcttatgtgattcccaacatgatgaatctctttaattagagaggagtgggtaatttggaaagaacgatttaaaatggtttcctttacaagtttaaatgtttctaatatgacataatcctgctggctggtttgtttttgtttttgttgttgagggggttcctggctctttttatgctttcaggtttcttaggaaagttgttaactgtgtacttgtaccccaaggcaattactgtgaaggggtatcttttaagcactagaactatttctctaattaatttgctttttatattgttaactgctgttggcctcccttcacatctagagcaacccttttttttcttatagcaagagggaaaatgggtgatttcctttccttactctaaacaaatcctgaaaaactagtttatcaaattagggtccagttctaagctgagaccttttccatttgactcaaagcaagctgttcagaggagaaaggagtaaggcctagagaagttgggtactatggtttctagttccagcctgccactaatttcctggcctgagatttcaggtgagtcaaaaatttcccatgactccgtttccttaatcagacatgagtgatagtatctgtcctagctttccttcctgggatgctgtgaataatacttgtttttaagtaaaaatattctatacataataaaaatcaacatttgaaacatcatacagataacattcatttgtatatataaccaaatttggataaagaccatgaaatattttgcagggaaataatgcatcacaatggcttattttccataactcataacaatgccatggtatatgtgatacaacagctgagttatgtgaaagtgtaagtagaaattacctaatgtccatgctctgaaccattgcaacagagagttcccatgatgccgagttatgcttctggtattactgcaatataaaatgtgaccatatcacagcctataacaaggtacagtcctttctacaaatactagaggtattctatctgctctctttctttgccaaacctcatatcctttctgccattgacttatttctggaaagcaggtttaaggcaaagaagtaagcaaaataaaagtaaaacatgagaactgaaaatcaaaagtttgcagaaagaacgcatgctgtcttcttgagagccaaactgtaaactacaaacttgttggggcttcctgagcctttctatttcattccttcatttcagggggcctaaaaataaatgcatgaaatagctctttcatgggccccaaggcttccactgccttattcgtggcttcttgcctttcataggaaggcttccagttctggaagtttctcttcatgcaaacagatccacttgaataattcctgagcttggatgagcaaagacaaatttccatatgcaaactcaacaatgaagaactgacagtttcagatggagccagcctgctgttgacctatttcaaaactgcatctgcaaagagggtcaggattccttttcctccacgtattggagagatagcctaggtcttccgagctaggcacttcagagcaattttgctcttcaagacaaaagtatgcttctgttcaccctaatgggatcatgaagacaatcaattaatattcatagagcactaatgcactgactcaccgaacaaacctttgtacacttttggaagtgagaaagggccaaccactgggaacccatttattttaatatctcagagggcctcatataatgataggtatatagtagatgctcagttctttactgaccacctataaaatgctaggcactacaaacacaaagatagctaggtcagagggaccttattcaaaggagaataaaaggcaaacctataaataaataaattgtcatgagaactataattttaaaagtaatggcgaagcacgcacacacacaaaaaagagtcaggatcagtttcataggaggtatttaagaggtatccctaaaactagccttaaaaactaagtattattggtaaaaatgttatttatgacaggaacctcaagtaaaagagaaaactaagaatgggcaaactattgccagtcccactaaagccaagttttccctgatgaattgtctcagagcagtgtttgggaactggaatattaatatactttttcctaatgatggactcacatattacatgcagacagctaagagttatttaatctcccattaagattttggccaaatcctgatttaatttcccgatcgctgtcacaggagcaaacattttcctattttcctcaggaacctgaaggacctcagaccaaaaacaatttaagagatgcctaaagggatggcctcaagttctacaattatctgatatgcagttggcgctccatatcgcaagtcccacaccccaacataaggacggccaactgtacttgacttgagcatctgtggattttgcaatgaggggatgggggttcctagaaccaacacctctcagatacaaagagacaactgtgactgaggaacctactgggagttaggaatcaaatagctccccacccacttccacccccatagtaccctgtacatccccttgctctgctccgttccgcctaccatgcagatccttcaatcaatgacatatcaccagttaaaactcccttccacttcttaggaatggagcattggagaaaattcagttccctcacatatacttgacagaggttacaagttacttaccaaagtcaaaattgtgcctaaaaagctaaaaccacattttttaaaaaagtcaactagaagaggaataccttacttagcattcaagaaccagcattgccactgattttggctaagaccacactagtggtcagctgggtagtaacaaatacagagaaccaaggtctcaagaacatgctgaaaaaattaaggaaatgtacttcgaactcaagagtcctctcctacctgtctagttatagagacaaggcacttgtttagacattatctcccaatctaagaaagcctgtcaaaagctagactcttcatccacatattgtatttccctatattagtcactcctgaattttgttaaataaaaattataggaggccatagttttggactaagttcctgcattagacccaaacaaaccagaccaaaccaaatggaatcacacattctaaaagtccacagaccagtttcaatcggcatgacaataaagttccctctatctttaatccttacaacaaaatgtaacctgatgttagccagttatttttcttctgttctgcttccctgttcccaccttacaaggaaagtaactttgcaatggtcatccactttttccttttttctgctttctttagctcttgtctacaaaatcaatttccccttctcgggtcattggaacactcattctaccttataaaatgaagtgttgcccaattctagaatggcgagtaaaatcaattaagatctttaaactagattttcaattttgtcttttgataatctaaaaggtgatatcctatacaacacaacatatgctactaggatttcctacctaataccagccaggaggtttaataatagattatcataaaaatacaacattccaataagtcctaaaggagagagtgaataatactaagataattagtataagaggcattagcggattgttttcatttcttttttaatccaagaagagttcaaatgagtgtatatttatttcttaggtaaaaaatctctcccattagagggaacacccacacctctgtccttgccatttacttatacctgttgtttcttacataaatcatgagtttaacacattacccgataacctgttaggtgacttttatatcctagaaacatatcttccaccctcttgtcctagcagtctatcctcaattttctttgctgatcttaggattgtacagtactacttacatgctaagaactgaactgacaaatgacaagtgattctggcttctccaggtgaaaaaaaaacaaactgtggaaaagaaaaagacaactagaggccaactgtgaatcatttcagactcttaaaagctaactagaaatcccacacccagtaatccatattaacgcaatgatcagaaatgctccattacaaaccatcatggatattcattatattactacaaattattattattattatttttttttttgagacaggttcttgctgtgttgcccaggctggagtgcagtggtgcagtcatggctcactatagccttgatcttctgggcttgctcaggtgatctcccatctcagcctcgcaagtagctgggactacaggcatgcaccattacacctggctatttttttttttaactttaaggatctcactatgttgcccaggctggtcttgaactcctgggctcaagagatcctcccacctcagcctcccaaaatgccgggattacaggcatgagccactgtgcctggccaatgattacaatttttaaaaggagaaaatatgtgcacctaattttttaaaaggagagaaccaccagcaaactgttaataccatattttaagtgtaagatgcccctgaatgtaagactcaatatgacttgatgttacactaacgagataacacagtcagtaaaactctttttttttttttttttttttttttccgagatggagtatcgctctgtcacccaggctagagtgcagtggcgccatcttggctcactgcaaggtccgcctcccgagttcacgccattctcctgactcagcctcccgagtagctgggactacaagcacccagcaccacgcaagtctaattttttttttgtatttttagtagagatggggtttcaccgtgttagccaggatggtctcgatctcctgacctcatgatccgcccgccttggcctcccaaagtgctgggattacaggagtgagccaccgtgcccggcccagtaaaactcttaatttagcatagattagtagatatattccactttcagagaggttaaaatgtagatcttaaaatatataaaatacaatagtgatataactacaggtgattaattatttatgggcacatgaacatataataagagatttggctaaagataatgtgcacacagaggcaatccagtcaagccggtaatggagagaaatcttaccaaataaattttcctactagtatcactatattttccatttaggtctactaaaaattttcatgaaaaagtattatcagaaaactgtaatacatccttcaccatgctctccagcttattcttttaactttgccctacctctgacagaacaattgttctaccgtcattactacactgctgtagtaatgctgtattggaggaagctatctatcgcctaatttttcctcaattgccacactcaactgtgtgcagtttatagaaccagaaatatttatatacttttggcttttactccctcaaccctatgagatgcacctactacccaactatatgggtaaacttaacccaaaaattactccttttctctggtctgccccaccacataccgccatgatttctctgcatcttcctcctaagcccaaaattaccaatttctccccggaatccatgaaatttgcttctttgtctctcccattagtctgtaacctgtaaagtctgtaaaaagaactgcccttcccccaagacagtaccagtgcctaatatggtgcttaacccaaagtattcaaaatgtttaatgaaatactgaaaataaatcatgaacacaagcacatgaaccagagaacagtaattatataatcataaccacattttgaacgcagttaaatattttcaaaagataaggagtatgtatggtaaaggtctttgaaaatatgaatcaaatttacataagtcccctattgcaaaatctgtaattttatttttattttttttatttatttttttttttgagacagagtgtctctctgttgcccagactggagtgcagtggcgcaatcttggctcactacaacctccatctcccaggttcaagcaattctcctccctcagcctccccagtagctgggattacaggtacccaccaccacgcccagctaatttttgtattttcagtagagacggggtttcaccatgttaggcacgctggtcttgagctcctgacctcaggtgatccgcccgccttggcctcccaaagtactgggattacaggcataagccaccatgcccggccaattatatttcttcaccagattttaaagcaagagcatattcaagtctccgttaatagttttattttacatgtaaaatatctgttttgttaaaatttcttttaattggtgaaaatctcttagggaactataaatttcatacattattttgagaccacttttggctaattggctcctagaatgattgctatgtatgaaaacctaaacaatatatcttattttcgaataattcatttactataatatcactacacttgtttatttctcacacgttccaaacataagaagccatgaaatgtcaccaccataataatataatgcagacactaagccaagatgttttaaatcacatttaaaaggtacacaatacattggcaagtttttttaaaaaatcactacattttctgctttaaatcactcaattttaataaaagaatatacacatacacatatacacacgtgtgtgtgtgtgtgtgcatgtgtgtgtgatgtgatttaatacataaagactggaaagctataaaacaaaacagtgatttcttaccagaagcaaattggggaataaggtgaaatttttacactttgaaaataataaataaatcagtatcattaattataacagggttgagcaaacagacttcacgtggtctaaaccttgtactatatacatatagcacttcttgaataatgtctaaatagtgataaaataataagaatttccacacagagatgcatgtattgtattattttcagccatgaagtaacacttcactcacacacgttatagtcaagtcatccatttcctgaaataaaatttgtatctgtcagtcacatgataaacattttttctattcttttagcactattctatactttcccagaaagattctggttataatacaaaaacatataaccagaaataaggtaatatacaaaaatatatagcttttcctacatggcagcaataactgctttctggaataactattttcaaaatacaacagaacaaagggccccatttataaaagcagcaaaaactcaatgaactcaagaaacacaggttacctataaagttatataactttactgagagatataaaataagacttgaataaataaaaagatataacatgatcttagactgaaatggtacactatcacaaaaaggctaattttctatacctttaacacaattccaacaaacatcctatcctctacaggccaacattaaagcatactaactggcaaacctccagaaaaaagcagctagtaatacatgaaatgatattccacctcacgattttctgaaagattagcgaaagtttttaaataaggtaaggttacactcctacaatgcaaattggtatcacctctttggaagacacgtggcaacaaatgtttccacttattctccaagggccagctcttggttaatatctatgagatttaaactgtcagacagacctactctgcagtattgcatcgttactgtattacagccttatttgctcactctttcagtggatgtctaagcctccatcagcttgtttattctccaaaagcaagggacataaattttattatctttatatcagtacttgttgattaacagaaaattgtgctaggggaatctgggaggaaatgaaaacccacactcatgacattttataataataaaatcaccttaacttcagaaatgttataggaatgcatttgtgattatcaattgttgtgtgttaagataacaaaatgcaattattaatcagactataaaaaatcaattatttatccatgtattcatctatgtttatcacctagaattatggcagagagggcattagctaaataaaaaggtcctaaagctgccgaataaaagttgcgaagcagagctagtttaacatgaaaatattcctcacctcatctttcatttcttctcctggtctgctaaatgtaaggagaaaaaagggtaaaagtgctccttataaagcaatggactctgtttacctttaattctaactatccaaggctaaaatcttgctgctgtctagcaaaatcataggacttttgctactaggatgaaattctatttatgcccaacatatgattaagttatttacaaaataaattaacaaatgcagctagaaacctgcctctggagaagcttatggccactcgtaagagaaaaaacctaacctactttcaaccggagccatgctttcccatgtcaaacgtcagaaaattgttttatactccctaatcagtactattcatcactttcttacaacaagaaagatggccatttccctctattttagaagggtccatctgtaccaataatttagttatcagacaacgtatccacaatccaagtggcacaatttaggaataactaattcttaccaaattaattttaaagcaaccttgtggtatgtgagacatatttatgtcaaaaatcaaggcattagtggtctaagaaaataagggattatttccattgaattctagtagccatagactaaacattcaagatggtaagtaaaagatctgaggaaaaccaaactgaaattatatagtatttgagagagatgaatatcagtaaaactcataactcaaagttcaaagctttattttttttcttcaatggcatagcacctctgttaaagacaagttatattcatatattccaaatgttcaaatcctgcacattaaaaataatcaaaagtacacaaggcaggtaaggttacttacctttttattgtgccttaggtgcaataaattaaataaattaaatctgatacccataaaccaaatcttccttgaaggataagtgcttttgaggtaaagattacagaaacaaattaattaagtcacattaatagagacagaaagtaacaaagtggttgccaggggtcagaaggaggggggaatagggaattactacttaataggtagaaacttccagcttggggtaacaaaaaagctctgaggatggatagtgataatgactgtgcaacaatgtgaatatgcttaatgacactgaactgtacacttaaaaaatggtgaaaatggcaaatctaatgttatatatttttaccacaataaaaaagaaaaaaactaataatcaaactgataatctaaactgaatgaaaaattgaacaatgtgtactcgtagaaaaagattaaaaatttgttagtaattagaagactttaaataaagagtgcgaatcatttccctgattacagactaatgacatcagtaagaatgacaattttctcaacaaatgaagcaaatataatactttaaacttattcttgtaacatgaatagatctccaaaaatagttaaaatttaaaaagcaatatacagaatctgattctttcaaagagcttctgaaagatttgctctcctgaaatgaaatttggtaagggaggctccaattcactgaaaagtggttaatgtaaaggaacaaatgccccgttttccatgaaagaaattgtactgccagataaggctgtaaaacttaaagatcagataaatggtgagtggacactgctgatccagatttagacagaaaggcattcttgaaaagactcaccatgtgaatgcccagccagcctctgtaataaaattcaaaggcagcaaggcaagcaaagcactttggcaaaaagtgtttcaactactcagcacaaaagaggtatttcattttatctgtcttcttggggggaagatagacatatttttagacagtatctaagtgtcagaaagattccaagacattaataccatttatgaacaaagagaagtaacaaagtgaacactattccacaaagtatattaaacaaattccttgtttctcctggcttaacaagggagagcgggtggaagggtagagaggtaggggactggcatgtcaatggaatagaaagaatattggaaaaataaatttcgtaaaattctttcaatgaattggttcctgagtcagataggttttttatatctacagaggcaggcctatgtaaatatcctataaacaatgtcattagaaggtctaacaccttttcaaagatcttggcatcttaaaggtgaagatttatattctctttcttggcaggtctctaatatgtctaacaaaatcattaaagggagatttagtcagatttgttgatcaggaaaacatccacagatggtaagagaaactgtgggtgattatcaccttgctattgtctttggccagtaggttcaatatttagggctgccaccctgaagacgttaacagaacccttctatctgctggagcaattggctaactttatactcagccatcacaatagctgtacttacaacctatcttcaaatacaagatacagaagacatggctaagagtacctaaaattccaacatatcctgaaaaagcacaatgcaaaacaactcagggtctgtgctccaatgacagtaagtctgtcgtagcagcttcctatataaacggcaagctattttattttgtgatttgatgacaatcaaacctaggggaaaagttaaagggaaactacatgttgtaattaattttccaagcaggtgccagagataccaaatcaaactcctgtaatactttttctgagtcagggaaagaaaatgaaaaaaataaggagagaaattacattcaagctaacaaccaatggcaagtactcaaataaatacatggcaaactgtaaggtgctaaggatacaaaaaggaatacatggtacccaccttcaaggaatttactctgtgctcctctgataaagatgtgatttctttcatcactgccagtcacctccatgactgctcttcaccatcactgattaagtaccatgacaggcagaattctaaagctgccccccaaagattcctgtcctctggctatttaaccaaacactaatctaggtactattgtgaagggattctgcaaatataagtttactaatcaactgaccataggatatgaagattatccagatggtcctaatctaaccacatgagactttaaaagtgaagaactttcttcagctacagtcagagagatggcgtacaagagagaagtcagagagattctagcatgagaagaatttgtcacgccattgctggctttgaaatgttaagggcccacattcaaggactggagagatgcctctagttgctgagggatggcccagctaacagttggcaaagaaacagagacctcagccccacagccacaaggaaccagattctgccaacaacctgaatgaacctgggagcagattcttcccagagcccagctggcaacacctagatttcagcctcaggaaacccacagcagagaaacaagttggggcagtcccagcttctgacccagagaatcatgagacagtctcgttttaagccactaaatttgtgttaatttgctatagcagcaacagaaaattaatgcgagaacttaccatatgcaagtatttggacacaggaacccatttaattctcacaacaaccctgaaaagttatcatcctccattttacacatgaggaaactaaggaatagagagttttaaataatctgcttaagaacacagaatctaggatctagtaatgactagagtggtttactgtatattcaagaaaactaattggcccataatggttataatatgaattaaaaattgcagctggaatttgactaaatttcactcaacagggaaatactttcattttaaagatcagaaaactttaaatggtttaaaatgaaaaggttctctaaatcagaggggtacttttttataatgtccttaagtgacgttaatatatcatataacgtccttaagtcaacccaacaggaaaaacaatattactaaaaataaattcaaacctatgtaactatgtacttcttcctgcatactcaaaaatcaagagcaatactttgtcaatcaaaggctacgttttaacattaatttttttaattcttatccacaaaaccattttaaatatggtattatatgaagaaaaaaatgaaagtaatttttaaaaaccatgtgagagagttttttcaagaaagagaaaaatgaggaactatatacagtaccacactatttagaggagatacatccctgctcaagaaagcagaaaaatccagataaacgcaataatatagaaagacatcaggggcaaaatacaaaccaaaaatgaaatctaatatttattttatgaggaagataaacagccagtcaatcacatgcaatggctatagaagatgaataaatggcatttcctactcctcaaagagttactgctaaagatagtaaaaatttaaaaagaatttgagtttctgttaagagagactcagtcaaaactcaagtgagaaatcaacaacagttatattccaaaacagtaagtgtcaaaaagtacaaatgggagaaataatatttggggagatgatctttaaataaccacatatacacctggagctttattcatcagtagcactttcttctactgctgatgttttcttgtgtgacttttcaccatgaattgttgactttcagagcatagtacaaagaaagattggggaacacagaagatcgtgcactgaggaatagcatgatatggaatatggagtttcttctcaaataaaccaaccctggaattccaaccagtaatgtgaatgtatgttattaaatgaacacctatttgtgttttgtgtacagatactgtactcatgtcactcttaggttcagtaataaaacatttattaacctatttagaaaaaaagagatgatttctagcctaataaatttaaaagcttaaatctaaccatagctaatattttctgtactaatgtcctatttttaaaacctccatctttgtcattattaattatgcatatggattgatatcatttatttgcaggtgttcctaaagtaaattgcatatatctatttagattttttcaaaggctgatagcatactagttgtaacttagaaaatgaaggtaccaagatcctttttaacctgtaaactctgcaaaactgaatgggctagaaaaagaacttacagatagttttggtcatatcctagttcttaggttggatggtcatttcaaggatgttcattttattattttgttttacagtttatactttacatgcatttatatgttccaagtgttacagtttaaaatgaactcaagaggcgatataatttcttgaaaatatagttataaacataaaaataaaatcatgaaaacatcacttcattacttcccacacacattaattctacctaattaaatttcccacatatattaagatatatattaatgtgctagatttaatagaaaaaaatcatttatataagagcacaaaatagttactcaagagaaattagcacctgcttcaaaactaaaatctctaaactaaatatctaagcaaaagaattcgcctgaaaactaaaatctctaacttaaatatccattaatatgctaaactaagaattttagtaagtacatagaaaatatagcttatagatctgatcttgaaaaactttttctctgtctataaatttaatgccataacactctccagcaactaaaatgctgcaggctaaatagaagtttagagttgtttaggatagattcatgacctatccaattgattgtcttacctttaaatattggccaagaatgaatgtcacaagtcagtttacagactgaattgtgcacccgtttccatttttttttctactataggtattattcccatttccaatttgtttttctatttgcctaatggatcatgcctacttcaatattttgcagtaaagaaagctcagaggattaggagttaaacattataaactttttcttattattagaaactttatcttcaagtgtcttcctactcttgttattagaaaaacattgtttaaagacattcgccacataaacaactcatatttctccaaaaagcatcctacctatcctatagtaatttatcaaaaaataagtttccagccttttcaacaggtgtttaaaatatgttaaagatagaaccaggttaatctgacctatccaactccagcttagcttttaacaccctgaaataacatccttatcttttaacactcaggaagggttagtatttctttataaatagttcctcaacttcacagacaagtctttaaggaaaggtttcctataagaatgtaaatttaagttctggcaagctatcttaaagaaaaaatcttgaccacagaaaagcattacacatagatgctcattagtattatttgtcataggaagataaagaatccacttaaatatccaacaagtaaaaattattacctaaatggcattcctcttataaatataatgagacatcaaaaacaatgttcaccccaaaacatgtataattacatgagaaataccttatgttaaagaaactatgaaaaataggataattacaattctaaaaaactgaaaaatactataaagtatgttaagtttttcacattattgtctttctgcaaatggtacacaatagacatgcataattttttaaatctgtaacaccatagttattttcctactactcattctttaaaatatgctggtaccacaaccattttaacacctagtccccatgaagcacatacctccttcctcacttttctggaacgcacatttccaacatactcaaccatctgaaatgcagatgaaaaattctcagatagaaactaacaatagacttgtcttcaggaagatgcaatcagttcctaagttttcatttattatcctggataacaaagtcaagctgaaaactattaaaatatctttgtcaaaaatatatttgactatccacaatcattacagcatataaacacactttggcttccatgattcctaggaattcttttatcagcctgtgtcaggatcctaaggaattttcacagttgctaaatgacttctgtggtccatcatatcactctaccgagagacatagccatttggctacagcttttaccattcttcaggggagaagaggtttatgcacaaatccagaaagctttaaagatgctgatttgctctgttttgtttttaatcatcaatttcactataaagggtcaacttaaaattaagaaataatggtttaagaaataagcaaataattctttgaagtatttgaatttatctctgggaatattttttcctaacctcaaagtcatactgcaatgatatttcccaaatataatctaattgcctgaagttttctttaaaaatattcaaaacctatctattttaacagcacgtgatggcattttaccagtgttttcaggctgccactttaaaaggtaaaacaaagtggtgacagctaaaaagtcttttcaaattaattccccattttcatccttgaaacagacaaatttccctaccacggacattttctcaatattggaatgctgttcaaaattactcaaggtggtcctgagtttgttatttgaatacccacgagcaattcatttaatttcatatatattaaaactgaaaaaacaactgttttattaattttacaggtaccaaatggatcttcccaagggaaaggagtaagcccatagttgtactatacatatatgcaagatgattttttttcctcctagggtaatttgcatctggatgagaggttggcttttaaattggcccactttcataaattaaaaaatgtaatacatttacagctagctgaataggaaatttctgtacttcattcctgccaaactacaagcaagctacttaattaatgggagtctgccattatctttttgccctcaagagaagaactaggcctatataaatcatttttctctctgtccatcatacttactgtaaaaagtttaataatatgggcaaccatacccagaattacactcagaaaacctactcccttgcttctcagcgtgctctgcaaatcagtgacatcagtatcccctgggagcttgttggaactacaaaatctcagactccccactgcgacctactgaatcacaatttgcatttaacaagatgcccaggttatcagtctgcacattaaagtttgagaagcactagtctagaggttaaggtagaaggcagaatgatatactatctcctgcttgcacgttctaagttgtagaaagctgcaaaaaatctacagtcagcaatgaataaatcattcctagagattactggtaaatctttaattaaatgtggcctttccacatagatttagaaaacgtgtgtggctgatgctcagtgcctattaacagcgttttcattacacaaccggaactagattttttaataacatactgaaaataggtatatctgttcaccattctctattaacaaagcattcttactaaagaattgtcctctttttcaagcctaagatgggtcttgtggatgaaatctatttttagttgctccaagttaaaaaatgttttaaagaaccttaatgtaagaatcctaattgaccaatttgaggaagcatttacttcacaaattaatttaaatatgcttgagacaaatacataacccctatcataggccctcggctcacagtagacagtcaatgttatacctgtaacaaagggtcctcataatttcaagaaggattttcataagacaataccaaataacaggctcctggaaatttataacacagtttgagtcacaaaagtacaatttgcagaactttccataggtttgcccaatatgcaacatgtcacacttgtactgacctgtgcttagtccacagaatttttaacaagatgctttctataaggatttcaactgtaacctaccacaaaagtgctctgggaataactttatccctctacaatcattgccttgttctaaacagagccctaaagtaaattaaatctttagaaaaacacacttttttgtttgtaaagaaagaaacatttcctgaatgctacagaatgtttccttgagaaactgtttatgttactgtgttgaaaaggtgtttatgttgctataaacaccttccatgtaacaggggatgcagtctccccattgtttatattgtaatcagccctgtttctggaaagatctaggcttataattcatgcctggactaaccttcactccattctatcccaattagatcactccaaattatattctatatttgtttagcataattgacacgtcacatgagtacaggggaggttaggttcataacacgcactgtaaaaacacacacacacattaaaaaaaataagcactacaattacaaagctcattaattagcaggatgttgtggtttgtgctgtgttagcctggttaagctgaaactacttttcctaggatcttccagtatggttctaggttaaagttgacatggaaccagaaagtagaatttgcacagatttggaagccaaaaatcgtcatggttactatattgacagtccactatgccagtggattcaggcttatctttgctcttctcaaatccctgtccaacttcctctacagataaacagtgctttaggcccaacatacctatacagatgataggtacactgaggcacagcttctcagagacacttccccaagagcctttctcagactaagtggggacaccactgatcctccaacttccctcttggactttcacttgtcaagcttccactataaatgcttaagatttaatttctataataaattccttatgctaataactcattggagttcttcttccgtgatcaaaccacaactgattctcaaaacggtttacttgttggctctagatttaaatggtttcttgtcattaaagacatgctgtagtatccagtagtaaatggcaacgcaaacttcaccttctgatattcagttgacagacagtagaatatggcctggggtctaaacccctctgacctcccaaaccttcatttttttctataacttttcaatgttctttttgctctatctttattaaccacaattgacattaaaaatcacatatttaaagtaatacaatttgatatgttttgacataaatatatacccaggaaaccatcaccatagtcaagataaggaacatccatcaacccctaaaagttttccccgaccttcatgatcctttcccctccctgccctgtctaggctccattttcaggtaaccactgatccacttcctgttcttataattatgctgcattttatagaattttgtatacatggaatcatacaatgtgtatgctttttcaggggttggcatctttcactaaatgtaattatttaaattactttgagaatcacccatggtgttgggtatcaatagttcattcctctttattgctgagtagtgttttatgatgtggaatttccacaatttgtttatccattccctgttggtggacatctgggtgtccttcagtttgggccaattacaaaaaaaagttcttatgaacttgtataagtgtgtaagtctttgtatggatatatactttcaattctcttgggtaaatacctacaagcagaatgattgggtaggtatgtccttaatgttttatgaaaattttttaaaaactgtttccaaagtgattataccattttaagtgtccatcagctaggtaaaagaactcttctatgggtgcagtggctcatgcttgtaatgccaacactttgggacagtgaggcgagtggatcacttgaggccaggagttcgagatcagtctgcctaacatggtgaaactttgtctctactaaaaaatataaaaattagctgggcgtggtggcatgcacctgtagtcccagcaactcaggaggctgacgcagagaatcacttgaacctgggaggtggaggcagaggctgcagtgagcagagatggcgccactgtactccagcctaggtgacagagcgagacgctgtctcaaaaaaaaaaaaaaaaaaaaaaaaaaaaaaaaaaaaaaagttcttctagctgttctacctttaccagtacttggtgtggtcagtcttttaaattttagccattctactgagaatgtaatactcttctattggttttaatttgcattttcctaatcacttatgatgtcgagtatcttttcttgtgcttctttcacatctgtatatctcctttgatgaagtgtctattcaaatcttttgcccattttataactgaaccatcttattattcagctgtaggttattcatataatctagatcaagcttgtccaacccgccgaccacaggccacatgcagcccaagatggctttcaatgcggcccaacacaaatttgtaaactttcttaaaacattatgagatttttttgtgtgtgatttgtattttttttagctcatcagctatcagtagtgtatttcatgtggggcccaagacaattcttcttccaatgtggcccaaagaagccaaaagattggacacccctgatctggattcatgcccttgtcagacatatgttaacaaatattttctcccaggctgtggcttaacttttgtaacttttgaagagcaaattgtttttattgtttcaatataactttaagcactaaagcatactgccttagtattagtgtattagattcctagggctattgtaacaaaataccacaaatagggtggcttgaaacaacaggaatttaaccattcatgctagaattctgaaatcaaagtgtcagtagggccatattccctctgaaagctctagaaaagaatccttccttgactctcctagcttctggaggttgctggcaatctttgaaatgcatttcttagttgtagcagcataactccaatctctgtctccatcttcccatgggcttcttcctgcctctgtatcttcatataaagtatctcctcataaagacagcagtcactggacttgggccaacagtaatccatgatgacctcatcctaaattgatcacatctacaaaagacactatttccaaataaggtcacattcaaaggtacctggggttaggattcaacatatatttgggaggatataactcagcccataacaggcatttagtgtttaatatgtttttaaaacccactgtaaatgatacagggaggctatgcatgtgtgaggggagagggtacacaggatatttctacatcttcctctcaattttgctgtgaacttcaaactgctctaaaaacattgtctttaaaaaaaacacacactgaacaataaattatttgacataagctctgacctccttgaaacagtccatttttgctgcaataactgttctcatagagataccttcgaaatcatttgcagaatttacccatggtcttatttccccaaaatagatgcattccttgcaatacaatcagctcagcttaagggtctaccctgagctgtccccttattaacaactgttaggtaaaggtacatgaagaaaaaaacttgtatgactgtttcttttaagatctctattgttctgtctccaaatagggtgtaaaaatgtagcatcctcctgtagtcccagctactcagaaggctgaggcgagaggattatttgagcctagggctttgaatccagcctggacatcatagcaagaacctgtctcttaaaaaaaaatgtgggggaacaggtgttaatgcagtgacaactctaaatctgcattcagagatgcctcttattccatccctgtcttccttcaataccacctaacagaaaatggaaaaatgcttctccaaagaaacatgttccaattatctattgatacataataagtcaccatcaagcttagtttaaaacagtaatagccattttactttctctgagggtcaggaactcagaaaggtttgattgtgtggttctagctcagagtttctcatttggctgcactgaaatggtgcctgaagcaagagcggtgcagggctagcagggcaaaggtctggctgcttaatacagttggtcttctcagggcccttggtctctcctcacaacacaatggcctctgagcagctggactgcttacatgaaggctgcaggtttcacaactgaacaccgtatttcaacaaagaaaggagcatcaccttttctgatctagcttcagaaatcacatagcatcatttctgcactactctattggctgaaacaggcacaaaagccaacctagcttcaaaaagaaaagacaaagaccctacctctcaaagacagaagtagcaaaatcaactgtgagaagagcatgtgggtgaaagataactttacggaaatctttggaaaattcaatttgccccagaatatatcctagttctccctggggcatcaagaactattgaccactcagttcaaattaaattctaaggcaaagctatacactgacatgcccaggctcaatattttccccattcttatttctcccaatactgttttccatcttgtctactacagttgagtataccctattgactttggtcctccaggtgttctgtgttacaaaaaccgaattcagaagttacttaccacaggtcatatagagaaactaatagcaatctcttgatgcacagctgcatcattttcaactccctccagttcaatgtcttctttaagttcaatgcccagaaacctgggttacactctagccctcccaataattattaagaattgcctataattcagagtttcaaatcattctttcattagtttaaagtgaatttcccattataaaacacacagatacacacacacatgcacacacatgtgcaccactttccttagctaaatatgattgatttttggataatttaccaattatggttcatggtatccattcactagttaaaatgcctaggaattactatatttccctttctacttccataaatcatgatgtcacaaatctttattcaaatataccatttctaggacacctcatttactttaagattctctcattctccataaaatgtaatggaaaataaattccacacaataaatattgatggaacactgaatacataccaggccttctgctatgtgtgaggtgacgaaggcaaataagacagtttccttcccctcacatagttaaggcatctaactatgaagacaaatttaccaacaaccatgattattacttacaatatccaaaggagccctcattaagacctaggagactcagttaaaaccacacccggccgggcacggtggctcacgcctgtaatcccagcattttgggaggtcgaggcgggtggatcatgaggtcaggagatcgagaccatcctggctaacaaggtgaaaccccgtctctactaaaaatacaaaaaattagccgggcgcggtggcgggcgcctgcagtcccagctacttgggaggctgaggcaggagaatggcgtgaacccgggaagcggagcttgccgtgagccgagattgcgccactgcagtccgcagtccggcctgggcgacagagcgagactccgtctcaaaaaaaaaaaaaaaaaaaaaaaaaaaaaccgcacccaagaggtcaggcgaggtggctcagacctgtaatcccagcattttgagaagccaaagcaggcagatcacctgagaccaggagttcgagactagcctggccaatatggtgaaacctcgtctctactaaaaatacaaaaattagctgggggtggtgacacacacctgtaatcccagctactggggaggctaaggcaggagattcacttgaacatgggaggcggaggttgcagtaagccaatatggtgccattgcactccagcctgggcaacaagagcgaaactccatctcaaaaaaaaaaaagggggggggggggactaccttttaaggaaaagtaggtaaatatctgacaataataaaacgaagagtactgattgttgacaaagttaaaatgtaagcaaaaattccagagtatacagaatgcctggcttgacagggcaccacaaatgaacctgacttgaagtgtggttccaggtgcctaccttgttagcctcatgaccagccacaaagagccatatttgtgtctgatcatgagactaacaaggtaggcaaatgccagcctgtgatgttccttacatagcactgtaaggagctgaattctacaggtaatagctagccaccaagtatttttaagaggtgaaaaaacttgcagacaacgtgatcttatacagttgcttgtctatatccatgggttccacatctgtggattcaaccaaccacagattgaaatattaggagaaaaaattacatctgtactgaacttttttattgtcattattccctaagcaatacagtataccaactatttatataacatttacaatgtattagttattataagtaatctagagataatgtgtagtatacaggagaatgtgcataggttatatgcaaatactatgctattttatatcagagatttcagaatccatgggtttgggtatccacaggaggtcctggaaccaatcccctgcagatactgaggaatgactgtagacaaacaaccctaacatctccatcaaaaaactgttagaactaataaataaattcagtgaagctgcaggaaacaaaatcaacatcatttttcaaacatcagtagcatctgtatatgctaacaatgagctatctgaaagataaattaagaaaacaatccattcactacagcaaccaaaaagaacagaatgcttaggaaaaaatttaaaccaagaagttgaaagacctgtacaccagaaactataaaagattgatgaaaaaaactgaagacaacacaaataagtggaaagacatactgtgttcacaagtggagaaattaatagtgttaaaatgtccacactacccaaagtgatctacagattccccaatcaaaatttcaatgacattttttacagaaatagaaaaaacaatcctaaaatttgtatggaaccacgaaagaccccaaatatctgaagtaatctcaagcaaaaagaacaaagctagaggcatcacactatctaacttcaaagtatactaccaagctacagtaatcaatacagcatgctgctggtataaaaagagacacacagatcaatggaatggaatagagggcccagaaataaatctacacatatacagtcaattgattttcaacaaaggtgccaagaatgcacaatggggaaagcacagcctcttcaataaatggtgttaggaaaactggacaccacacacataagaatgaaattcgacccttacttcatactaaatataaaaatcaactcaaaatggactaaagattcaaatgtaaaccttgaaaccataaaaatactagaagaaaacatagcagaaattctccatgacattattctgggtgatgattctttggatatgaccccaaaagcacaggcaaccaaaaacaaaaacaaaaaaatagataactgggattacatcaaactaaagagctctgcacagcaaagaaaacaatcaacacactgaaagacaacctgcagcctggaaaaaaatatatgcaaaccatgcatctgataaaagactaatatccaaaatatatgaggaactcaaacaactcaatagcaagaaaataaataacctgattttaaaatgggtgaaggacttgaaaagacatttctcaaaagacgacatacaaataggcaacaggtgtatgaaaaaatgcccaacattactaatcatcagagacatgcaaattaataccacaatgagatatcacttcacacgtgctagaatggctattatcgaaaagatgaagatagatttttgcaaggatatagagagcagagaaaaaggatccactgtatactgttggtgggaatgaaaactagtatagccattatggaaaattttaaggttcctcaaaaattaaattattgacctagcaattccaaaactgtgtatacatccaaaggaaacaaaaccagtatttcaaaaagatatctgtacttccattttcactgcagtactagttacaatagtcaagatatggaatcaacctaagtgtccatgaagagaagaatggacaaagaaaatgtgaaatatatatccccaatggaattgtgtgtgtgtgtgtgtgtgtgtacaaatataattatattaaaggctgaatactattcagcctttaaaaagaaggaaatcctgtcattttcaacaacatgaatgaacctggaagacattatgttaagagaaataggccagacacagaaagacaaataatcacatgatttcatgtgtatgtgtaatctaaaaaagctgaactcattgaatcaaagagtagaatggtggtgggtgggggcaggtggagagttggggagatgttgttcaaaggatataaaatttcacttgataagaggaataagttcaagagatttattgtacaatatggtgactacagttcataacaatgtattttattttgaaaaacattaaggggattttaagtcttctcaccacaaaacatgatgagtacctgagataatgcatatgttaattagctcaatttggccatttcacaatgtatacagatttccacatcatgttatacactataaatatgtataatttttatttttcaatttaaaaaattatttttttaagtagaaaaacttgatgagacccatgttttcagaaaggtatttgtccacaatgagaaaaatggtttgacggaaaggagcccaaaagtaggaaaaattactaagttcaggtgaaaaaaaagaagggctcaccataagtcaaaagacatgaagtgaacaaaacagatgcaagaacatccaatttagtgactgatggcttgaaccagaacagggggtggttgctggtggggtgttggtggtaatcaaagcatcctgtcaaaatgagaatctacagaagttggtgagatgcatgtgtcaaagtcaaatagatcaaaagctaagagaggaaataaaccaagatgacagtgattttaaactcactttctgcaagaagcttggttaattttaaaacatcatccataaatggcatactaagtgacagaatatgacctcaacacataatcacaaatttaaatagtaagacttttcatcatggtgatcaccttatttgctaaattataaacttttttttcctccaacaaaattggaatgtagaaaccagagtgcctgagatgtcagagaacaagaaactttaaaaacaaagtcataaaaatgaataacagaataaaaatggaatctgtacaaagtacacatatgtaacagcaaaaataacaagtgggcagaggataagaattcgaagaggttagcctataagttctaaaataaaaactcttctatttcagtaattcctcattcatccttaccttggcttatggcattgtttcctatgcctcacttgaagatgtctgaaaggactatcgtgacacacatttgtcctgttacaaagaagtgggcttgattgctccaacagttggtaggtttttcctcgtcctctatgcctgtattgcgtcacctcggaaggcttatgttacaggtaagcagtaggccaggcatgtaacattagaatatatccaagcattaactgttcatactaccactagtttagataccccctcagtgtgatcccagctcagccatttttcagctgttgttacgtgagctaaaatgtccttcatggtccaactttacattcccaaagatggtacagaaaacatgcatttctgtcttgctatgtctgaaaaacaagggatagttggtcactgacagtagtcactgtttaaaagtcaccagccctgctctttctttttttctctctttttttttttgagatgtagtctccagtgcagtggcacgatttcggctcactgcaacctctgcctcccaggttcaagcaattctcctgtctcagtcccccaagtagttgggattacaggtgcacaccaccacgcccagctagtttgagacgaggtttctccatgttggccaggctggtcttgaacttctgagctcaggagatccgcccacctcagcctcccgaagtgctgggattacaggcgtgagccaccgtgcccggcccctgctttttcaagagaactggctgatgagcttcctgggaccactggttagactgctggctctccctttcctctgcagcctctccatcctgaatacaattccagagccataaccgtcaagtaaatgctttttttttttaaccttttaaatattaaacaactatacaaagccagtcttcagtgaaacatgctgttagtataaggatacagatttctggcgttgactcatttccagttattatgcattccaaatcacatgccaaaattttaatgaactttcaaatttacatttatgaaaacagaccttggcacacataaataggttatttttccatatcacttttcaaaaggtgcctcatagctaaaatgattctgagctgtcttctgtcattcaagatgaactctacaaaagaacttagtgttcttacttttacactaatttattctacattcattttagtcagcatatggcaagcatatgggaaagagaagtgtatctggaagctgttagaactgcatgtaatcaaaatctaccagtagaaacctaatttgattaattgaaaattaaagtagtagttaatcacttgctatttaagtagggggtgggtatcacttaaaaacgaatctttctcaaacatgtaaaattaattctctttgttccaaatcaacacttactattcaattggcagtatgaagagtgcaaggcaccccctaaaacctttaacaagtaggccctggcttaatgcgaaagtgagtagtaaattttcaagacggtgtctacatttgaaagagaactgtttcttaaaacatcactttagcagttaattgacctttaaaagaagggaaaggggactagctgaatccagatcaagttccaccgatatctacctcttaagttttgaagcttacaaacaatctacaaattcatataatctgttaattgagcatctttcggcaatctacttcttacttacaaggcaccaaaagaaaatcagtgtctggggaagagctaaggaaatatttctgaagcctaaaattgcctcccccaagttgactgcagcctaggctcaaaacttccttcatttttttaaaatgagaatgttaaccctacaaaaacgtattcataaaaaggtcctagtttatataacatttcttaaagcttgcctttaaaaaagagacccttataggtttcctcctttcttcccaaatctttggtctaacaaagtaatcaaaaccaaaattaatctcatgttcaaagccagcagatgatttctcaagattacccaatttcttcctgcccatgcatgcaagaatttgcttattaacttcctcaaagatagagcagcaatattagaagaaaattaaccaatcacaaaatgtcatgtagtctattcccaaaatggaaaaaaaaaaaaaaaaacaaatctcaagcccagaaaaatagataaatcaattggctcaacattttaatgttaaaatcataatagaataaaaggaaaaggaaaggtactcttcacaataagaatctataacaatccaaataaagtatgcctaaaatcatgattagacatcaaaatataacacatttgtttaaaaaaagaataaaagcagtttacatgaggggagaggtagccataataaatctggaaattaattcaataacattaagatattcaaatgtatattccctgctgcttaatccaaaaggagaggttctatttcaatgcatcacaataaaatagtttagcatctgtctcctactaaccagaatcacagattttgaaactgctctaaatttaaaatactgcaactttcccatcataatgttcttatttatggtctcacaaaactgcaggtaaatgaaaaacctacagaacacttgaaacaagtaaggatgacaacagatccattcccttacctctcaccccacattccgcccttccccttttataaagaaaaatgtcttcagtcctatcagtttcctttcacaaacactctgcatcatgtatcctcaggaggcccatccactaaaaggagaatgaaagtgtttacagatggtagaaagagataggagaggacactaccgcagtgccaacactatcatcccaggatctagagacctaaagcagaagaaattctagtcaacaaaaccccagtcataactgtagggaggaactgaaagtaaatcttagaggtaaagaatgaagaagacaaaagattaaaaattcaggcacaagaaatgatttagatgggtaagaacaaaccactgctttacaaagtcagacttcatacaattcaagtagactagcctcgtaaattaaagaaacttaacagaacaaaaagtaataaattcataaaaaaaagttttaaacccaaacggctaaaaagatttgacatgttcactaatggaagtataaaataagtatctataaaccccataggtccagcaaaaacaaaatatggctaagcatccccattttacaatactgaaaaacatttccattttatggtatcactaattcatatggctgtcgtctctacatcctcaaggaactcataaccaaaagaatatggtatatgatttcattttaaataatttcatttttaaagtctggtgattgtgtgtttggaaaggggtggtgaagacatgacaaggaattacaggtcaatgtacatcagtgggaatcagaagcacaaggtctctgttcttttcatgcaagagaggtatctattgtcctaggcttcatattgcatatgatgtatgtacaatgcccacaaccgtttacattccatgaagatctaatgaactccagttctgagtgggttcttcaaactctctccattcagagtccagactgggtacccagaacatctggtagcacaaatcactgaagtctaccaaagatggcaatctttttgttttatggtggattccttttttttaagtatgttcaccatggacagtatactcattaaaatatgtactgaaaggtatatttattctgttcaaagttcagctgaaatgtagtgggggaaaagcttttactgtttctttataattctttgactctagataaaaatggttctcactctttagttgtgcttgtagtggctttaagtcattgaaacacccaggcattgagtaagaggtggcccttttgaatttgttgaagatgtgtttctcttctaccttggtctttctcctaagcattaatatctacaacacttgaggttttggcttttgtttaagcataaataattgaaatactgtatgataccatgttaaaaataagccaccacgccaagactgtattaatagcacagttcaagtcactgctgtaacgtacatggcactgcatctttcactaacaaacgaaatgtaacctgaactttgtcttacacatagccttgaaaacagatatttcattactaccacatatttttgttttatatcctgccaaatgattaactaagttttattgtaaaagaactgtcaatcagagcacagtataatgatcagggtacaattattatttttttttttttacatctgatatccaccacttacaaacttaggcaggccagttggcttcctggaagctcaggttcttcataaagatgagaatatcaacattaccttagctgaattatgtgaatcaaatgtgaaaatgttttataaaccctaaaattctatttttaaaaccatgaaggaaagactgacaggctatattagataaatattaaatatttctgcttggcgaaagagcaaggcaccaccactatcaaatgataaactagaagaaaatatgtgtaacacatctgaaaaagagttaatgtctttaaagaattccaacaacttgataagcaaaaagaatccaagaaggaaaaaaatgagcaatgaataggagaaatgtgaataaacttaaaatatgcgaaaaggtactcaaccttactggttggcagagatacacaaataaaagatcaattttgccgccaggcgcggtggctcacacctgtaatcccagcactttgggaggccaaggtgggcagatcacgaggtcaggagttcaagagcagcctggccaacatggtgaaacctcatctctattaaaaatacacaaaattagccaggtgtggtggagtgcacctctaatcccagctactcaggaggctgaggcaggagaatcgcttgaacccaggaggcagaggttgcagtgagccaagatcatatgactgcactccagcctgggcgacagatcaagactccatctcagaaaaaaaaaaaaaaaaaaaagatccattttgcaaaaacttggtgattgttaatattcagagttggtagtactataaggaaatgtacattttcatacattacttgggagaggggtttgaaagtttctacaatcttccagaaagcatttggtaaaatgttattatttaaattttttaaattatacatcctttagtctaggaatcccactttcagtgtttattcaactgaactaaagcaccagcatttaaagatatgtactcaagaatgctttgccattactgcttaaaagaacaaaaattggaaatgtggttgccatcaataccagaaaggctaaataaatcacatttggttctctctatagaatattatgcagccattaaaaataatgaattatatatctgcatctattaacctcaaaataagtccaagatatgtttaagtgaaaaattaaagtcagagaataatcatgtgactggtattatttaatattataaaatttaaaacaaattaaaacattttaaacatgtctattagagcctaatactagagtggtggtgtatgtgtgtgtgcatgttcatatggaaggatgcttattaatttctggggtgactgagttataaaacttaaacgtattacttttgtaatttaaaaaaaacttcaagaaaaaaataaataattaagaacaaatgaaactgatcagacccagtattggaaagaatatatgcaaatacaaacatatgcaaataataaaaaattgcaattgcaataccttttcttcaaacacaaaaaaattaatctaccaagaaattttaagtataacacaatgagttacaagctggaatctttacagtacaattccttctctcaaactattaccagaagtaaaagcaacagtgaattacattataagatggtagaaaaggcgttatgctatgaagcatcattaaatgtatcacatacattgggaggctgaggcaggaggacagctagagcccaggatttcatggcctatgacagagcctatgaatagccactgtactccagcctcacaacatagtccctaagaaaatatgtaagatttttttttaaatgcatcacatacagatacacagacatcacagatacacatacatacatacatatgcgcacacacatgcacacacacacacctctgcctctccttcctcttcagcaagtaaagcttagaagaggaacacctataagtgctcatactgaaggcagagaagggcaacagtagccacagcagacattaataatctatcacagcactcttctctgtggagcagagagcagcctcagaattgcattaccagtacagagttctaaaatagaagaagcccatccctgagtaggagaggcataaagcctagttgaccttgctggagcaataaaaagaaaaaagcccccaagtctgagctgaagatgagacacagacctcttcatgcacttaacctagcactacaagagcaagctttcaaaagtattcctttaataaatactaacctaaaatactcattcttgatatgcctccaagaaaggctgcaatggtgctgttttacggactgtggaacaacagatgtctccctatctggctcctgatctgaaattccattagcaatcatattttcactccacagtagatttttcttagatgtttaatacagcaacagcatgccaccatgaatcagcaatatcagatgcccgcccactttgataggttggtatgttctcctaaccttaaaacagtggctctcaaactgtgactccagaactattagcaccacctgggaacctttggaagtgcaaattctcaggccccaccccaaatttaatgaatcagaaactttgggggaagagtctagcttgttctgattctgataatggctattgttgcagaaccactgcccctaactatacattataaacagcatctatgagtacaagtgtttttatcctatacaccccctaagtttaatagttaaaaatgctgtttcactagcatgccatgttatgtcattaagcaaagttcatttattgtttttggttttttaatgcagctgattttattttcaagaaactttgttcccagaagtcagtaactgaagttactaaaatagctatgaccatcaccacaactgcttctaactatactgccacaaagcacagtacatgactaaacgcatctccacactaagcatgcagtttgcagagcctgtcttttggttagaactcctgtttatggcattgcccattttgcaacacaagctataaagtgactaagtaaataatacatacatactccacggtataggacaattcaatacaaatgatcaaacatccactacacataagacaccatattaagaactgtaagtgaggctctgttatatttctctacaatttggttttgggggtatctctctggagagtagccataaattctagtcttgccctgatagggctctaggaaatatagttgtagatatttacagtgtacctttcatgagatccttcttcatcctggcagacagcctaatgcctaagtgtctgacctgtgaccaggtgtccctctcacaggaaactggtttatactggcaggtacccttgtggcccttgtctgacctgtgtccagtttattcctcccaagatagccactctctgggagagctctgactaagaggaaaattaggtctgggtctgtcagtccgatgagacacagaggaggaaatacaacacaaacatgtgaaataccagaagcaacgtacgacaaattggtgagaggaggagtaccaatgcgggcgaaagacaagatggcagggaaatgcactcaaccagcagatgggcagccagagagaaatgagctatgggccaaggcctttattggggtccagggaactaaccaagcaggtttcctgtgggaagttctagttggtgggtttagagcaagcaggcaaaagttctgtggagtcacactgtgaatgagagtggctaccgtggcgtatctgcagcagtccatgcagggtacggggggtcagtcaagtaggctgtatctgtatgtccatgagggaggtggttgtacacggcaggtatctggctcgaccacactgaggaaccgggaggaggcagggagtggatagtgtgtcaaggatgactgagccctgcttctgtgtgaaacaagttacacctagattcagaatagatgctgaagcaacataaaattataaaaattcactgtaattcacatcttggtgcctgggcaccagtttttaaatgtcagataagtgtaagtctgaggggtggatgcactgactgtaaggagaaagtggatttggtggtcatattcagaggcacaagtcaggagattctgatggaaagttggaaggggtagtagggaaagacaccagtgggtaggtggtcctctcccctagggagtaaggggttgactgatacgaggcaggtgtctcctgaggaaagcaacagtcaccattaattgtagtaactcattccggattttccttgcagtatggaagtgtaggggtgtacatttgagtggagaacaaggaggataccaggatcatgggctaaggaaacagtgggttcaggaagaaaaccaaaaaatgtcctgtgtcctgatgagtggaggttttagtgtcccaggggaaggaatcacaggggcaaagtcatctccaatggagaggtcctgggttgggtgatatcatctgggatgtgagactggggtatggctttttaagtgactgcccactcgagctgatgcaggcctctggactgtaaaccattaaacacccaaaccagtagcaatgagactaatattcaacaaaatgatatgtagctgtaccatataggggtttttattatttttttattttttttttggtggtggagatttaagctcaaataggtcccccatatcaaatgagaaactgcctggcccatgggacaatctatttttaataggtcccaggaaagaatgtgcccttgatctagctgccagcctttatgggatggcagcaagatcacaaatgtataaagatatgacctagggcaagatagaaactgttagggctttatttgttgggctgggatttgaaaaggagtcgtttgaggaaatcattatgcctctcgattaaatcattacctaacacctgtcagggacatgaaagttctactgaaagcatcttccaagaaaccagtattgtgttctaggaagtgaaatgtgtttcctggttaccaccagtaatatcttcaaggcaggagattctcagtgtttcttaccttgaaggaacaatttttttttttttttttttttttttgagacggagtcttgcactgttgcccgggctggagtgcagtggcgttatctcggctcaccgcaacctctgcctcccgggttcaggcgattctcctgcctcagcctccctagtagatgggattacaggtgcccgccaccacgcccggctaattttttgtatttctagcagagatggggtttcactatgttggccaggctggtctcaaactcctgacctcgtgagccacctgccttagtctcccaaagtgctgggattacaggcgtgagccactgcgccaggcctcaaggaacaatttttaggcaatgctccaattgtttataataaatgtaacgatgtcactacttgtaggccagggcattcagtgctgaggggcctgcctgaagtttggccaagtttgttttgaaattttaagtaatctaggactggcatacttgcgggacctggtgaatagggactatagggtttaaagttccttttctttccctcttgggcttgaagccaacaccatttttagttcctatatctgactgataggagaaaatgggggaggaggaaggtatctctaggcagcagccttttcttgggatggccagagactgtgagatcattagtccctttttctccccatactcaccgttttgttttttgttttgttttttctttttggcaaaatcttttagaatggccaggcagctaaataattatttttctttctttggatgtttatctgacgagctcctggggtcccatatggcaaccatagtaagtggccacctctactatggttgccatcagccggagtcataacaggcagcagcctcttttgaggatctccccattgaccttatccggatcaggctgtggccttccccaaagctcaagcacagaccgcctgatgtaagactctgcggctggggagtatgtctgaagaaaattgagtcaatatatattccacaccagagcaacatctatttgcttttatacaagaaaaagactcacaagcaatgttactagacatgttatattgtgtgccatgggagcataacacctaatgacaaaaaaataaaacacagaagcaaagccagttaagtaagagatatctagatgtcagccataaaccccagacccagctccaggagtctgtgactatgaacaccagcactgcctcagatatctcctgactccgctaaggactcaccaatcccacctgtgacccacatgaaggaggagaaagtatccccatcacataagcttggaaacaaatgtttacactaaacggctctctggtcacaaccagcacaaacgatattgtgactttttttttctaatcgcactccaatctgataggcagcctcacaaaaatatgtagaaaagcacaacactctacatgtatacacactaaaatactttaaattacagttaatcacagagctagagcttctacagtcttactactctcatttcttgacttacctccaaaactttcattacctgtcaggtcccccttgttattcctcattttctatgtctcaggaatgctattgatgctattgtattaaataactgtcatgccaaaggcacataatactataaagtttatttgcaatgttgagcagaaacatctatttcttttttatatcaaagcttattagaatgctctatcatctatggagtgtacagaatcatttccagatactcttgaaccaaaaaagaatctgagcctctcctaacaagtagttacaacaatgtagaaagattacatgggaatgttaaattggtaacacattttacctcaactctgtttccaaatatattttcagtaagttcaatgggcaggctaaaaggtaaaatctgtccctagaaggtatattatttttacaacaggatgagataatttaaaatgtattataataaatccaactcatgcattttaagcatctactcaattttcagtaatatgctagaaattttcagtaatatgctggaaactgctatgcagtttaaggataaatgttttactttattaattagctataggaaataatatacttacgcagtttttgtattttttaaaaatagtctaattccattttgttcaataagcattgatttactgtccaggtgctagtataggttgtttcagacttcaaggagctcttagcctagtattatataatatttactgtgtattataatgtcattggaattttggaaaatttcctcagaaaaacagaaaaggaaaagctatattgagatttttacaaggtattggccaacagtttctacctactgtagagggctacaaaaccaacatcaaaaaagaacaacacaaatctcatagctctatccactgagagggaccagaaggagtggcatcccagtaacaatgaacacaaatggcacccagattgaggtttctaaatacaatcccccaataaaaggaaccaaggttttttagggtcagcctagtgacagagtgagactctgtctcaaaaaaaaaaaaaagaaaattggttgaacccaagataagggcagtgaaaatacaaggtgtgcctagatcatcctgtggggtcagaaaataaagaagcagggccaggcgcagtggctcacgcctattatcccagcactttgggaggctgaggcagatggatcacttaaggtcaagagtttgagaccaacctggccaacatggtgaaacctcatctctactaaaaatacaaaataagccgggtgtgctggtgtggtgcctgtaataccagctacttgggaagctgaggcagaaaaattgcttgaacctggaagacggaggttgcagtgaagccaagatcctgccactgcattgcagcctgggagacaagagcaaaactctgtctcaggaaaaaaaaaagaaaaaagcgagaaatcaaataaaacaaaatagagaagcagatggcaaaagagatgaagacttgtcagaaggcatagaaggcaactcacaagaaattacactggccaaagttggcgtaatttaaacaataaaatgagcaataatagtataaccaaaagaataaatattcatgaagcatagtgctatgaatgaatgaatgaatggtaggctgagcgctgtggctcacgcctataatcctagcactttgggaggtggaggcagaggcaggcggatcacctgaggtcaggagttcgcaaccagcctggccaacatggtgaaacctcatatctactaaaaataaaaaattagccgggcgtggtggcacgcgcctgtaatcccagctactcaggaggctgaggcaggagaaatcacttgaacccaggaggcagaggttgcagtgagccaagatcgcgccattgcactccaacctgggcaagagagcaaaaactccgtctcaaaacaaacaaacaaacaaacaaaaaaaggcaacttttccttacagaaaaattataattaacaaatgcagaagaaaataagagaaacagaaaaacaccatgagaacattacagtggtaactgctccaggcaaaatgcaagaatggaaacaaaaataagtgggcaaaattttaagcacaaacaagatatcacgcaatctcaaagtatctctcccaagacacttagtaatcataaagataaaataaaattttatagtgaaggatcctaacagataccaccttaaacaagtgaacaaggttaacaccagtaatacatactgatatcatgtaccatgtacccctgaggtgatggaatgaatgagaagggcttatcgaatgtatggagtccttctcaataatgtaaccacagtctaatcacgagaaaacatcagacaaaccccaaatcaagggacattctacaaaatacctgaaaaagaattttcaaaaatatcaaggtcatgaaagacaaagacagactgagcaactcacagataaaggagactaaagaaacatgacaactaactgcaatgtgggatcctggtttggatcctgattttgctgaccctgcaatactctttaaattaactaatgctttcattaattaacaatgagttaattcttccttcctataaaaggtaaaaaaggaatagtgtttttaaatcattaaatagaaaaaagttggaaatacttattaaccagaagaaatttagattactctttaaattacagacttttaaaataaatatttgctaaatacaatcaatgtggtatcctagattagatcttgaaacacaaaaaaaagatattagtagaaaaactagacaaatctgaataaagtctggaaattagttaataatggtgtgccaatattagcttatcagtttttacaaaagtttttacaaaacccttaaagacttttaacaatagaggaaatcgagtgaggagtatacagggacactctatactatgaaacttttctgtagacctaaatttattccaagacaaaaagttttttatttatatgtcatcacttttaggtacctaatgattgccagatggaagcatgtcattatattaggccatattaagagccatatataggcttttttgactatatgatatacaatgacgtacatagttaaactcacagaatatcactgaatctcacttttcaaaagaatacatacatgtggccaacaatcatatgaaaaaaagctcaacatcactgatcattagagaaatactaatcaaaaccacagtgagaaaccatctcacgtcagtcagaatgcctattattaagaaatcaaaaaataacagatgctggcaaggttgtggagaaaatgaaatgcttatacactgttggtgggagtgtaaattagttcaaccattgtggaagacagtgtggtgattcctgaaagaactaaaaacagaattaccatttgacccagcaatttcattactaggtatatacccaaaggaatataaatcattctattataaagacacatacatgtatatgttcactgcagcactattcacagtagcaacgacatggaatcaacctaaatgcccatctatggtagactggataaagaaaatatggtacatatatgccatggaatactatgtaaccataaaaacgaatgagatcatgtcctttgcagggacatgggtggagctggaggccattatctttaggaaacttaacacaggaacagaaagccaaataccacatgttctcacttataagtgggagctaaatgatgagaacacatggacacatagaggggaacaacacacactggggcctgttggagggtggagagtgaaaggagggagaggatcagaaaaaataactaatgggtactaggcttatacctgggtgatgaaataatctgtacaacaaacctctatgacacaagtttacctacataacaaatctgcacatggacccctgaacttaaaagtcaaattaaaaaaaaaaagaatatcactgagtctcaattggaataaattgagacagtcacataaacagctcacaaatcctatcaatgaaaaagcacttatttcgagttactttgtaccagctaagttccatcctaaatgctgtgaaaagtgatttccttcatgtaacttaaagtccagcaaaataggaaggcatataaataaaaaataatgtgaaaaataatacaagaaaatgaatagagactaatatgaataacaccgcaataaaaacacacaagggttaggcacacaacaaaaatggttgactgggagacagtacagacttccctagagacagagagatggttgaactgagtcttcaattaggagcacaagttagccaatcctaagaaaaaggggacgttctcagaaaggaggataacatcttaaaggcacagggacaggaaaatccaaggaacatttgggaatagcaaagtgttagaagagaatgctggccatggccacggctgcagaaaaagccagagacgcagcaactgtcctaaagctgagggaagactaagagtgggagaagcaggacatgtagaatagtggaaaaggcaggatttcttctaagacaaaagagttgtagacaggctgaggatgtggaagaattcacagaacctttgaaataatttttttaaatttaaatgagttgcacagctaagctgtaaactttttttttgttctttcttttttttttaaaggagagagtcttgctctgtcacccaagctggagcacaatgggcgatctcggctcactgcaacctccacctcctgagttcaagcgattctcctgcctcagcctccctagcagctgggacttcaggtatgcaccatcgcatccggctactttttgtacttttagcagtgatggggtttcgccgtgttggccagtctggtttcgaactcctgacttcaggtgatctgcccaccttggcctcccaaagtgatgggattacaggcatgagccactgcacccagcctaagctgtaaactttaaaccaaatcaattgagaatttgttcctcaaaaaaagagtctcctgctcactctctctcgctgtgtgtgtatatgtgtgtgtgtgtgtgtgtgtgtgtgtaaatgagagaaaatggatgtgaaatgagttcaaaaccctcaagaaaacagaagaagaaatcatttaactgtaactcaaactcaagcctctatggtggcttttgattcattaccacattacagtaactatcataaaagcaaagtttaaactgacaatgttggatatagatgctctaagcaggaagaaatggtaagaaaatgtgttctcaagtaatgcatgaaaaagaaaattcagtgctttctgttctttaaataggtattgaatcctggatttaatggagaaaaatcccttattgttcgtgatgccataagcaattaagaccagctagaactcattaattgctgaaaaaatagccgtaatattctcattctatttatccaatgcagcttagtattcaaggttaacagcagtctaaaagaagaggaaagaatgaagaagaaaacaagaaatgtaataggaactaaagggagacagcacgtgatattaaaagggaaaattataattaagttttgactgtcacagttttttttttttttaacactctgaaatatgtggtggaaactttcctcattaaactgaatgtaaaaatgtagaaacacatttatttctagagcccagaaacaagttttgatacaaaaaaaaaattatttaaagaaagattcccactaccagcactaaactgttcatgtttttaaagtactactgtagtacagaaacaagttccatagagaagactgttaggtagtttccattccaaataagacagccaaagtcatcccttccagctttgaaagtgaccaaaaaaaaaaaaaaagaattttaaaaattaaaatagttctgtgctgtatttaaatgataaattggatattaaagcttaaacattatttgaaagaaagcaattaacatattttaaaattagcttttcctcttcaaaataatgatataatcattctggaccaaaacagtaattatatcttctcttagatataatctcttagaacatataattattgcctgtcaattttttactacccttttgaggtcatatgtgatatttattccctcttgtttcaaataggtaaggaagagcttactgcccagtatgcgcttggaggggagggtggatacagaaatctgtagtgtagtgtaagaagaaagagtagagaagaaaataaacagaataaaaacagttgttttttttctaaattgcaagggatgctgtcaagagaatcaaaagaaaagccacagactagaaggaaataaatgacatatttgataaaggatatacaatatacaaagggcccagtgcagtagctaacacctctaatctcagcatgtggtggtgcgtgcctgtagggccagctactctggaggctgagataggagaatcatctgagctaaaggaagtcgaggcttcagtgagacgtgattgtgccactgcactccagcctgggcaacagagtgagaccctgtcttaaaaaataaataaataaataaataaataaaaataacaacaaaatatataatgaattcttaaaacccaaaaacaaacaacccaattcaaaaatgggccaaagaccttaacagacaaatcaccaaagaaggtatacaaatggcaaataagcacattaaaagatgctctacattatctgtcatcaaggaaatgcaaattaaaacaacgagctatttctacacacctattagaatagccaaattccagaatgccgataacacttcatgctggtgaggatatggagcaacaggaactctcattcattgctggtagaaatgcaaaatggtatagccactttggaagacatttggcagtttcttataaaactaaacatactcttaccatataatccagcaaaggaacttcttggtatttactccaaaggagttgaaaatttaagtccatacaaaaacctacacatggatgtttatatcagctttattcatagttgccaaaacttgaaagcaaccaagatgtccttcagtagatgaagagataaactgtggtacctccaccacacaatggaatattattcaacactaaaaggaaatgagctatcaagccatgaggaaactgaaatgcattttactaaatgaaagaagccagtctgaaaagactacatctgtatgattccaactatatgacatttaggatagggcaaaattatagagacagtaaaaagatcaatgggccggatggggtggctcatgcctgtaatcccagcactttgggaggctgatgagggcaatcgcttgagctcaggagttcaagaccagcctgggcaacatggagaaaccccatctctacaaaaaaaatacaaaaatttgccaggcattgtggagtgtgcctatagtcccagctacttagaaggctgaaatgggaagttcgcttgagttcaggaggtggaggttacagtgagccaagatcatgccactgctctccagcctaggcaacagagccagaacccatctcaaaaaaaaaaaaagccacagacacacacagagagatcaatggttgtcaggggtcaggggaagtggcagggagaagggatgaataggtagagcacagtggattttttggacagtgaaactgctctatgtgattctataatggtggatagatgtcattatacacttatcctaacccataaagtatacaacagcaagaatataccactctggtaggggatgttgataatggacgaagctgtgcatgtgtggggttgggggttacataggaaatctctgtaccttctgcttggctttgctgtaaacctaaaattcctctaaatttttaaaaagtaagtgttttgcttcttaaaatactatttgtatcaagatacaaaattaagatccttatctcagttctggtataacaatctctgcaaaaacttctataaaactactgcatagtacaatagaatattgaaatgtttccaccagatgaaatgtactgtaatcaaaatcatcttccatactttttaaagcagagaaaaggaataacggtgactaacgaaaaataactttttttaaaaaaaatgacaggctctcgggctctcattgtgttaccaggtgaactcaaactcctgggctctagcaattctcccagaaataacatttttaaataaaaatagtaaataaaaattactgtggcacagggtagctgtcatgaatgacccaccaaaagttttaccaaatatctcaagtgtgattatcactcatacctgttccccattcccttcatcccagcccagcaaatctctgaatgaggttcctgctgggcactgcttgcctgaaggttccccaactccacaccccctctaccttgcttgttttcacaaatgtattcccaaaggagacaagaagtcaaaacttgtccttccaaaaggaaaaagacaaatgctaaatccttgtgagcagcttcagtcagaagggagcaggaaccctgtcaggctacagagggcgctacaacatcctcagcattcaggaaggcacctagtagcttggcccagtgagggtagaggataaaggaggggaaaaagagggaaggggaagaaagggatgagaagtataaggaaggagacaggggagaggatatgaacaagaaagtagaattaagaagaaagactaaaaaaaaaaaaaaaaaaaacagaggcgtgaaaaaagtagctagctcctcaacatttataagttctacaaacagaaagacaaattcaaggccgggcacagtggctcacgcctgtaatcccagcactttgggaggccgacacaagcggatcacctgaggtcaggagtttgagaccagtctggccaacatggtgaaatcctgtctgtactaaaagtacaaaaattaccgagtgtggtggcgtgcacatgtaatcccagctacttggtaggctgacgcatgagaattgcttgaacccggaaggcggaggttacagtgtgctgagatcctgccactgcactccagcctgggcaacagtaagactctgacttaaataaaaaataaaaaataaagacatcttagagttttttacagtactgaggttttaaatgaaatctaaagctcttgttttcattcctcctatcaaatgttaacagtatccccactacacatgcttcttatttcattcatctgtaaaccattcctgtcaactctcaaatgtaggtctagtcagtcccaaggtcactgagcacacaggcttctccatttaataggtttaggatacaaccttgttgctgtaagattcttttcagcccttttaatgtgtcagtccaggcttttaatacctttcatcaaactattacttataactggtctcacaagaccgattgtagtctaggttgaagcctgaccctctaaatttacatgttgtgacattctttaagaatttattgaaaattatggcaagaacatttgtactgagaccaaaaaagcaatacattttataattttggctatcactaagaaaggcttggagtttgacaaggtagaaagggtggtgggaagcattgctttggagaagatatgtatgttcaagatcagaaaatactgtaacatttcatggaaaaaaattccataaaatactagggtataaaaatcacgtaaaaccaaaagatgtgttcattaggcacccatgaggtgccaaacactctgctagctgacaataatgaacttttttaaaaagtaagcttatcaaagactagtgtacatacatacagaaaagtgcaatgataataggtatacagtttgatgaagttaaactaaatcaacaaacccaataaactacctctcagttcaagaaatggaacattaccagtttcccagaagccttccccagtacccactaacattactacaccccacaaactagacctgccaaaaggtagtaccatcctggttctgaactttttattaacagaagcatagaatacacatgcttatgtgtattgcttatgtgtatggcttatgcatagaatacacatgcttatgtgtatggcttcttaagagtcattcacattactgagtatagcagcagttagttcatattcactaatgtagatcattctgttgtaggaacattctacaatgattgacagttttaagctattataagtagtactctagaaatattcttgtacatgtcttgtacatgtacccacacacacatatgcacattcctaggagtagaacagctagatccttgggtatgtttatgtttaactttactggcagttttcctaagtgctcacatcaatttacattcccaccagcagagtgagaatttctgttgttctacattcctgccaatacttcattgtctttagcaattctggtggtggtgtagtgaaatcaccttgtggtttaatttgcatttccctaatgactaatgaggctaggcacctttcatatgtttattgtatatattggacacttacgaagtgtctgttgaagtctttcattcactttttctattggattggctgccttttctgaattgatttggcaaaatcctttatatattctggacacaagtacttggtccaaagcttttaatctatttagtatgaacatgatacacacagggaaaagacaaagaacagtgtaagatcaaagggtaaggttatgtaaccagcctatgagtgttctaggaacacagaacaaggaataatcaatttaaggttattgtggacagagaagaatatataaagaagggaaatctggaggtgaaccatcaagaaatttaatacatttatcaggtagaacaatatgcaaaagcataaagagccataagcagcaaaattcaactcagaatgagccttattcctggattaacataatttcctctcctaagggtcaaatctttcctaaggttcaaatctttactgggcacaaaataggttggataaaaatgagggcagatgacagtagtctatggagttttgaacagaccttacttaacacttcaaataccttatctcatttaatcacaaccctgtaatataggtatttaccaaagaaaagtcacctaatgtcacagctaatcagcagtggaattagcctaagcactgaggtctgccacttctaaagtccatgatttttccactgaacagtctgtatctcaacaagcaaaattaaagttcccactatggtagctcctgggaactgaagacaaaaacaataactaaactggaacatcaaaagctttagaatttcatataggtaatgtttggtcttcttatataatgcatttcaaaaaaatgtgctcaaattgaatatccaagagtcaaactggaaaagtcaaacaacaggcttgctgaagtgccacaattctaaaatacctgtatttcagaatgacaccattaattctgtaacatcttaaggtgaacacattaaatgagcacatttattacacggtatcctgatttcagaaatgaggaaagtgttacaccttagaaccaagaaagcacaataaatgttatgagagattatctattcccagtgcaatagaagtttattaaaatccctaattatctgtaacgtttttagaaacaatcttcaacaaaatagttccagcatttggtacatgttcattaactgtgttcttctgcctcatcattaaacacagcttaaatctaatgagcatctaattgaggttaaagacccatcctaatgatttccatctttatctcaatcacattaagattatggctataccactgggtgtgtgtataaatatatccatgtgtgtgttcacacaaatacataaagccattctctgatttcaacttatttttataaaatgggataatgcatttaatctgttacacaaatatatactgctgtgtagacagggatagcacaccgccaaaacccaactggtaacaggaaagtggctatattagtttcctgtggctgctgttaacaaactaccacaaactttgtgctttaaaataacagaaacgtatttccccacagttctggaggcgagtagctcacaatcagtttcactgcactgaaatcaaggtttcatcagagctgcgctccccacaaaggctctaggggagaatctgttctttgccttttcctggtggccacggacagacattccttgacttgtggccccatcactccatgtgtgtctccatcttcacagtgccttcgcctctgtgtgtctgtcaaatctcaccctcatttcactaggatacttaagatgaaatttagggaaaactcagataatccaggatgatctctttatctcaagatccttaatttaccgcatctgcaaggatcctttttccaataaggtaaaatttacaggttccaggtattaggatgtggacattttggggaaccagcatttggcctacaacagcagcctactgtaaaactgttgagcattctcatcagttaatatacaaggccccaactgtagacagggtagggaattttaatgtgtactgtatgaaagttcagagtacactgaaggccaaaatcaagaaaaatcaaagactaccagtgtcatgctacagatgtctattagtagtgagagcctggatcagggttatcaactctgactgaacattaaaatcatcttgggacattttaaaactactgactctagggccacacctgagactacgccttacaatctgggtatgcagcctaggtttggttggattttttttattaactcaggtgatccaaatgtgcaaccaggtttgaaaaaccactagcccaacagaataacaaaataggatggagaccttaattatacagtaaactgtttttggtttgtttttgttatttttttaccaatttaatgcaaccacctcttctcgttagggagaaaagattcctttaaaaatcacgtttgtaacttaatttgaaaatatgttcagattaaaagttctaaaaactgatgcatgacacttttagccaaatcagagtatgttagcagaatgtcaaacccaaacccaaatacagtacaaaataaatgtctagttcataaaaaggaaccgccagttagttcatttaattgacctttctctaaaagtatcaaatgcttgtttggaataagccactcatgaaaataatcatattgagatcattttagaattatacttgctgtttcatgattttatttttatatcaaagaccactacactaaggcatgagaaatgacaaacaaaattcagagactagaaaagatgattaatccaatccttttttttttttttttttttttttggtagggatggggttctcactgtgttgcccaggctggtctctaacgcctggcctttaacaattcccctgccttggcctcccaaagctgacaggcatgagccatggcatcccactgtaatccaattctttatcaaccaggccagttacacaaactgagggttttattttcctgtctctgattcctcttcattctttctggggctgcacttttatctacttacctaggattgtttaccacctccactactgagaaagagaagggaaactcaaaagtcagttgattctattttgaaatgtgtattttttgaaatgcctcctatttcaaaggaaagcctatacacgtcaacagttgggcataaatgttaatgcttgttaattttgcttagaaacgccatgttttactttgattagtatgatgaataactgcaaaggtggcaaaaacagtatctcaataaactgatttcacaaatgaaggaagattagaccaggaagtcatacaacggttggattttcattgttacccttacttctcactacatggataaaaaattaccaagactagaacacacacatatttcaatattgaaactgttaagtaagagttactaaatctttgatttaacatacgtattttattcacatacaatgaaaggcaaaatgtatggccagtggaaaaacttcaaagccaagtcacctatcaaaatgttcagagcttaaatctgccaagataaaggggttaagctgtcagcttctagatgacggagagaggaatttattcagcaacttcccttcaagatgtgcaaaatgttttcagaaatccgtacctatattatgtcttgttctctggtaaatacatgcataaaaacagttactgaatataaacaggtgttcagtaaaccatgattccaaaagtcctgtataaattgcttgcacattttgggttttgcttgctctgtagcccatcctctacatcctgggtttcaatcgattctcctgcctcagccttccaagtagctgggaatacaagcatgcaccacgacatggataattttttgtgcttttagtagaaatggggtttcactatgttggccagcttggtctcgaactacttatctcaagtgatcggcccaccttggcctcccaaagtgctgggattacaggtgtgagccatcgtgcctggcgctgcttgtacattttgagcaaattatgtattacatattttatttacatctttttaacctaatttaattcatctacttatatttttaagatacttctagtttttttcccaaaaaagaaaaatccaagaataatccagttttgcttttagcttttttttttttttttgatacattgccctttttctcctctctatccaatattcagttgctttttttttttttggaaacatagtcttgctcttgtcacccaggctggagtgtaatggcgcgatctcggctcactgcaacctctaccttccaggttcaagtgattctcctgcctcagcctctggagtagctgtgattacaggcgtatgccaccacgcccaagtaatttttgtgtttttagtagagacagcgtttcaccatgttgtccaggctggtctcaaactcctgacctcaggccatccacccaccttgggctcccacagtgctgggattacaggtgtgagccactgtacctggcctcctttcaactttatattcacctatttttatcttttttaaaagcaccacttgcctttgttttaattctctgtcaagcaattaattgagatttcatcctgctggcaaccactctagttctgcagcatcctcaatgagaagcaaggtccacttctcatttgtcttcctttcaactgtttctatttccacactttcactagcaatattaatttcaaccaatttctaagacaagaagtatgccactgaatgtataactgatcttaacaacagattaacaaattgttgattccctgccattttcaaaatatcaaatatacaagacagtaatttttttaaaatattttttcatctctgagggaaaggatgatttgaagactcctttcaaattcccaagaaagcctctcaatattatctgtgtaaactactgattcacaggaataaatatttgttatttaatataaactaaaatgaaaatttttagctttcacaggaaaagctaaaaattttcattttagtttagactaaataacaaatatttacaaaacattcactattcgttagcttagtgacagacagcactattcaaaagcccacaaaaatgaccaaattaaaacgattgcaagttgttttcacagctatgttccattacagatttgttaacggcccctaaatgtcatggcctcaagcgaaacattaaaccttatcagccatcatttaatctgtaaagtgaagatattcaactatgtgataaagtcttcacaataatctagaaaatactgcttagccaaagtgaccctcgcaaacattcaccagcaatactttaaaagattaccttctgttgttagaaatacattatggaaaaatgtaaaaaaataggaaaaaaaaatatatatatataaatcactcaaaccatcacccaagagtaacaactgtgaaaatttgtggaatagtaaaagacaccaaaatgtaatatgttcataatcgtaaaaaattaacacagttgcagtcatatagtatataatttgagcctacattttcaacttgtatcataaattctgtcctaggtcattagaacatttaagaaaatgtcatcttgctctctccttccgccacccaaggttcccaaaggaaagaaggccaagagaaagaaggtggctccggcccctgctgtcctgaaaaagcaggaggccaagaaagtggtaaatctcctgtttgagaaaaggcctaagaattttggcattggacaggatatgcagcccaaaagggacttaactcgctttgtgaaatggccccactatatcaggttgcagcagcagagccatcctattacaagcggctgaaagcacttcctgagattattaaccagttcacccaggccctggaccattaaacagctactcagctgcttaagctggaccacaagtacagaccagaggcaaagcaagacaagaagcagagcttgttggcctgggctgagaagaaagctcccagcaaagggcacatccccactaagagatcacctgtccttcgagcaggagttaatatcatcaccaccttggtggagaacaaaaaggctcagctggtggtgactgcacacaacatggatcccattgagctggctgtcttcctgcctgccctgtgtcgtaaaatgggggtcccttaagtgcattaccaaggagaaggcaagtctgggacatctagttcacaggaagacctgcaccaccgtcacctttacacaggttaacttggaaggcaaaggagctttgactaagctggtggaagccatcaggaccaattataatgacagatatgatgagatctgccgtcactgggtccctagactgtggctcacattgccaagctcaaaaaggcaaaggctaaagaacttgccaccaaactgggttaaatgtacactgttgagttttctggaaataaaaataattaaaataaaacaaattttccttcaaaagaaaagaaaagaaaagaaaatgtcatcttgatggctgtttaaaaaatctaccaccagaatgtaaattggtacagccattatagaaaatagtatggaggttcctcaaaaaattaaaaatagaactaccatatgatccagcaatctcactactgggtatatgtcctaaggaaataaaatcagtatcttgaagagatatctgcacccccatgttcactgtagcattactcacaatagccaagatatgaaaacaagccaagtgtccatccacagatgaataaactgtgatacatataagcaacagaatattattcagtcataaaagagaaggacatcctgccatttgtagcaaaatagatgaacctggaggacattatgctaagtgtaataagctagacacagaaacacaaacactgcatgatccacaggtagaacctaaaaacgctgaagtcatagaagcaaagaaaggttgttgccaggagctgagaggtgggagaatcagggacatgttagtcaaagggcacaaagtttcagttaaaatctaacttctggggatctcatatatatagcatggatggtgatggatatgtgaattaatttgtggtagtcatggcacaatgtacacgtatatcaaatcatcaggctgtataacttgtactcaatcctaatttgtcaattaaatatttttaagtaaataaaagtcatccttaaaaaaaagctaccaccagaatattcaacagttattatacaaaatagggatatttcgaaagagaaatgtttagcaaatttatttctaaaaattttgtaagtcatgtcttcggaaagttgctaccgtgggagaactgacccaacttttaaaaagcaagtcaaatgaacagcaatggcaacgatgggaaaaagtcttcattagaaatgcatctttagagctttcaacatctgaaaaagagaaaggtccaatttaaatagtgatcctatggccctattttaatcctttatataagctatcaaacagatcattccaaataatctaaagtttagaaatagttatgaattcatgcaatcatgtgaaaagttctgaactttagtagcattccccttcatttttcactctgctttgtcctccttggatgaacagaacactgtgttctaactattctcctcaataagcacactaaacacataagcacttagaaaattataaagaaaaggccaggcgtagtggctcacacctgtaatcccaactttgggacgccaaggcgggcggatcacgaggtcaggagatcgagaccatcccggataacacagtgaaaccctgtctctactaaaaatacaaaaaattagctgggcgtggtggcaggcgcctataatcccagcaacttgggaggctggggcaggagaatggcatgaacccaggaggcagagcttgcagtgagctgagatgatgccactgcactctagcctgggggacagggcaagactccatctcaaaaataaaacaaaataaaataaaataaaataaaaagaagaaaattataaagaaaaaatagattaggaaccaaagacatgaactaatcatggtttgctcaaacaagaatgagcagatcaaacttcaaagactaagtcttttatagcaggggtccccaactcccagggcctaatactggtactgttaggaaccctggcctgttaggtacggggccacacggcaggtcagcggcaggtgagctagcgttaccgcctgagctccacctcctctcagatcagtggtggcattagattgtttctcataggagtgtgaaacctcctgtgaactgcacatgtgagggatcttggttgtgcactccttataagaatctaatgatgaatttaatctgatgatttgaggtggaacagtttcatcccgaaaccatccccccaccccatccatggaaaattgtcttccatgaaaccagtccctggtgccaaaaaggttggggaccactgtttttccatcacataatgtaagaaaagaagtacagcagcaccacagggtcaatcaggtctaccccagaaagccctggtgccaaagaggccacagccagcaagccttttttaaacacaatataacttttaatagaaaccaagaaaaaaggaaatgcgcaaccaaaaaaatcaatcataaaatatttgagtaatgagagacaaaaaaatagttactgaaagaaaaccatattctattcgctcagcaggaagagactctgcaaggagcacacgtttaggattacaatacgtactgaccagccctgaaccagcagggtcttggtacagcagagatgctcaccagaattaaattcagttcaggagacattagctgatcctctcaactcccacatgtcccacatcctcaatgacatcactgcaaaaactgtttgataccggcaagtgttaggagaaataggaagatgcccatccatttttaagctagaaatatccaaacaatgcataaattagacccaatgaggttgccttttaatccaccaagaggcagacatgactatgtgattttattactaaacaaaacttgtaaggacctcctgtacttattaaatataaagtagcttttaaaagtccatcacaggtatatttctgactgtaatttttaaagggggattttttttcttaatgtagtcaagcaggcaaagagccaatcaatccattagaaaaatcaaagagccagaaatctatgctttgtcattaattcagccatgcgactaccattactaccagcatctttaaaaacaaaacaaaacaaaacaaaacaaaacaaaaaaactggacagcagggaataaatggatagcaaaacagaaagaagaaaatggctttgtggtatttatcctacaagtgaggtagagctcatacttctagctcatgcttgtccttgggagtgagcaagtgtccagggttttggcagggcacacagtaataaaagaagacaccatgagaaagccttttctgactccagattttgatgggtatcatttaggcaaaaagagtatactgggattattcaacccttttccccactgcctttaatactgagcacgccataaaaaccaatatgcaatgctagcccgtaaaattaaaatgctatatgcctactgttctctcggaatcagtctaatgagccaactgtagccacagttagcttagaagaaaaagtgaaccaaagggaaaatagtaacataggtaaggcataatactgtaatcaaagtcccttcaattttaaattggattactgatgagtcttcctgaagggtaatcttttgtagtagtgcctattttgtttgttttaataaaatctactgtgtgcatcttttaaaaatacaaaattactacaaactacctagccaagactattttttctccactccagtatgggacgactcctgcaggtagtagctgtttaactagaaaaaaaaaaaaaaactgccaacaagcacatactgtgcagaaaacataagcactacatttatagacagcagcagctttccagaacatctatgatggcagcctgaatgaagaacaaccgtctggttcttcatttataatgaaggtttcagaaacacaaacatccaggaccatgaaaccttaggtgccctgcattgccagctgtaaaactatagatgggaagtcccaaagtagccaattatttaaggccatatatgagctgtttcaacatatgcattcatatacacttacctttctcttaactacagatatttaaaatattatacattctgaaataggttgaaaaaagcaaatgagtactcaatgttattaaagctgggcaagaaagagctaaggccaaatcaatgcatactacatacagaatagaatgtattccatataagtgaaaatattacatttgtctagagtagggggcagagttattttttaatctgttacggaaatgtacaatttacagaaaatgatgtattctttttgtacaagaaaatatattttagataggctttcttatctgaagaatgtttttattttcctacagatgattatctcaccttcataaacatcttgagtcataagctccagtgcatggttttcctaataaaagaacacttaacatttttcacccatttacactttaaaaagaagcgggggtgagggagtcctgccaattcacatgtatacatctcaaacaaatccttggttccaatgtgaattttcacatggttattttcaaatatttggactaattcagatataaagcaatgcaagctacaaaagctaaatgtaattaaaacaccaagaagaagaaatttaaaagcactaccattaaatttataaacttcagatcctgcagatgatttattgccctatgaaaataaagtctaagttgcaaaatgtatttgacagacatggcatattataagcactccaacatcaaagtatcatagtttatgctgtccaaatacattaatcttcatcttagcctaggtttgaaacatatattttaaaaactaattacaaatcagaagacaaatgataaactacatggcagacttataatattccttaatataaatgcaaggttcatataactattaaaagatttggaaacctccactgacttgagaagataaagtctcccattataccatctgggtgttagaattcttatggaaaaaaattatttgtgccccatgtgttcattattgctgatggaattagaaaggttagtttttttagaacctaagaatttagctactattctcacttttatttgtaaaattcaaagtaataaaatataccacattgaaatagcacttaatgagtgccaagcactgtgtttaatccaattaactcttgaaacatttctctgaggtagtttctaacattatcttcattttacagataaggcaattgaaacaaaggggtcaaattacttgcccaaaatttataagtaagtaagtaacacagctgaaattcaaatccaggcaatctggctccagagtcttaaccacatttctagagcatgccatattaaacaatcccaaccttctttcctggcttccaacctccacctcaatatcaggaatacctgagaaggcaaacattcctatctaaattcacaccatctgcaatttcttttgaaaaagtaaattcgtataccaaagttgctccaaacatgcttgagataaaagagaaaagaaggaaattcccttacacttcccagaaagagaaaatgaatacaaaatgcaaaaatttataaactatataaaattaaagaagtaaggcattacaaatcgagtttttaaacattcctatttagtcccttaaaaacataaataaaacaccaatgttttttaaaaatctgcacaggcatacctcagagatattgtggattcagttccagatcaccacaacaaagcaaatatcacaataaagcaagtcaagtaaattttttggtttcccagtgcaaataaaagttatgtttatactataatataatatacacatgtgcgatagcattatgtgtttaaaaaatgtacatgccttaactttaaaatgctttattgctttaaaaaaaatgctaacaatcacttgagcattcagcaaatcataatcttttcactggggagcagtaatgcctggatgttgattgctaccaactgatcagggtggtggttgctgaaggctggagtagctgtggtgatttctggaaataagacaacaatgaagtttgctacatggattgactcatcccttcacaacagatttccctgtggcatgtgatgctgtttgatagcattttacccacagttgaacttcctccaaattggagtcaatcgtctcaaaccttgccactgctttatcaactaagtttatgcaatattctaaaacatttgttgtaatttcaacaatgtttacagcatctttaccaagagtagtacattagtccattttcacagtgctataaagaactacctgagaatgggtaatttataaataaaagaggtttaattgactcacagttccatatggcaggagaggcctcaggaaacttacaatcatggctgaaggctgaaggcaaaggggaagcaaggcacaccttataggacagcaggagagagagaacaaggggagaagtgccacacttttaaaccatcaattcttgtgagaactgactcactatcacaggaataacatgggggaaatccacacccatgatccaatcacctcccactagatacctcccctgacacacggggattacaattcaacatgagatttgggtggggacacatagccaaaccatatcattcttcccctgacccctcccaaatctcatgaccttctcacactgtgagatcaatcattccttcatgacagtccccgaagtcttaactcattccagcattaactcaaaagtccaagttcaaagtctcatctgagataaggcaagtcccttccacataaggaaggtcccttccatctagaagcctataaaatcaaaaacaaattagttacttccaagatacaatggaggtacaggcattgggtaaatgctcccattccaaaagggaaaaagtgcccaaaacaaagaggctacaaaccccaggcaactccaaaacccagcaaggcagtcactaaatcttaaagcttcaaaataatctccactgacttcgtgtctcacatctagggcatgctgatgcaagggctgggctcccaaggccttgggcagctctgcccctgtggctctgcaaggtagagccgccacagctgctttcacgggctggtgttgagtgtctgcagcttttcctggtgtacagtgcaaggtgtcactggaggacgatggccctcttctcacagctccactaggcagtgccccagtggggattctgtgtaggggctccaacccatttacctcctgcactgccctagtagaggttctccatgtggcctccacccttccagcagacttctgcctggacatccaggcatttccacacatcctctgaaatctaggcagaggttcccaaacctcaattcttgccttctgcacacccacaggtccaacaccacgtggaagtcaccatggcttggggcttgaaccctctgaagccatggcccaagctgtaccttggccccttttagccatggctggagctgaagtgggtggggctggagatggagcagctgggacacagggtgccatgtcttaaggctgcacaaagcagcagggtcctgggcctggcccctgaaaccatttttccctcctaggcctccaggccagtgatgggaggggctactgtgaaggtctctgatataaccctgggggcattttccctaatgtcttggctattaacatttcactcctctttactaatgcaaatttctgcagccagcttcaattcctccccagaaaatgggtttttcttttctacgacatggtcaggctgcaaattttccaagtgtttatgctctgcttcccttttaaacataagttcgaatttcagaacatctctttgtgaatgcatatgactgtatgctgctagaaacatccaagtcaaatcttgaatgctctttgcttagaaatttcttccaccatataccctaaatcacctctctcaagttcaaagttccacaaatctctagggcaggggtaaaatgccaccagcctttttgctaaattatagcaagagtgacctttactccagttcccaataagttcctcttctccatctgagaccacctgtctggacttcactgtccatatcactatcaacatttttgtcaaaaccatacaataagtcttgaggaactcacaaacttcaacatcttcctgtattcttctgagtcctctgaactgttccaacctctgcctggtaccccgttccaaagttacttccacattttcaggtatctttacagcagtgccacactaccagtaccaattttctatgttagtctgtttttgcactgcaatgaagaactacctgagtctggataatttataaagaaaagaaatttaactgactcacagttctgcatggttgaagaggactcaggaaacttacaatcatggcagagagagaagcaaggcacatctcacatggcagcaggagagacagcacaaaggaggacctgccacacttttaaaacttcagatctcatgagaactcactatcataaggcccgcataggggaaatccgcccccatgatccaatcaacacccaccaggtccctcccctgacatgtgggaattacaatttgacatgagatttgggtgaggacatagagccaaaccctatcaagtagcttccatctcaaagaaaccacttttgttgttcatccattagaagcaactcctcatctgttcaagttttatcatgagattgccgaaattcagtcatatcttcaggttctacttcaaattctacctcttttagtacacctaccatatctgcagtcatttcctccactgaagtcttcaacccctcaaagtcatcaaattcttccaaaatcctgttcatgttgatattttgaccccctcccatgaatcacaaatgttcataatggcatctagaatagtatatcttttccagaggttttcaatttactttacccagttctatcagaagaatcactatctatggcagctgttgctttatgaaatatatttcttatataatagtaagtgaaagtcaaaaattactccttgacccatgagctgtagaatgggtgttgtgttgccaggcaagaaaatagtatcaatctcctcatacattcccatcacagctcttctgtaaccaggcacatggtcaatgagcagtaatatttttttttttttttttttttttgagacggagtcttgctctgtcgcccaggccggactgcggaccgcagtggcgcaatctcggctcactgaaagctccgcttcccaggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccagagcagtaatatttttaaaggagtcttttttttctgagcagtagggctcaacagtgggtttaaactattcagtaagccatgcagtaaacagatgtgctgtcatccaagctttgctcttccacttctacactacaagcagagtaaaattagcataattcttaaggaacctaggattttcagaatggtaaatgagcagtggcccttaacaagaaagccatcctgtcctttgaagatttgaagctaggcattgactcctcatcctggatggtatcttcaccattagaaagctgtttggtttacattgaaaatctgttgtttagtgtagccacctttctcaatgatcttagctagagcttctggataacttgctgcagcttctacgtcagcacttgctgcttcaccttgcactttcatattataatggtagcttctttcttcaaatatcatgaaacaacctctgctagcttcaaacatttcttctgcagtttcctcactcctctcagccttcaaagaattgaagagatttagggccttgctctggattaggctttggctcaagggaaaattgtggctggtttgatctacccagaccactaaactttctccatattagcaataaccctgtgtcgctttcttaacattcgactgttcactgaaggagcacatttagtttcctgcaagaaattttccttcacactcacaagctggctaactacttggtacaagaggcctaacttttgacctaactcacccagcttttgacatgctttcctcacagcacttaatcatttctagcttttaatttaaagtgacagacatgcagctcttcctttcactggaatacacagttcaagtcttacatgggtatggcttatggtgcccccaaaacagttacaatagtatcttcaaagatcactagtcacattcccataacatatataagaataatgaaaaactggccaggtgcagtggctcatgcctctaatcccagcactttgggaggccaagaagggaggattgcttgaggtcaggagtttgagtctacagcgggctatgatcgtgccggtatactccaacctgggcagaagaatgagaccctgtcccagaaagaagaagaaggaaaagaaggaggagaaggagaagaggaggaggaagaggaagaggaagaggaggaggacggaggaggaaggaggaaggaggaggaggaggataaaaggaaggaaaaggaggaggaggaggaaaaaaactgaaaacattgcaagaattaccaaattatggcataagaacacaaagtgagcatatgctattggaaaaatggtgccaatagacttgcttgatgcaaggttaccacaaaccttccatttgtaaacaatgcattatctgcaaagcgtaataaagtgaagcacaataaaacaagattcccctacaacaggggaatcaaaactgtgtagtactgtcctaaagacagacatataaataaacagaacagaatagagaacccagaagtaaagtcttatagatatggacaaatgatcttcaacaaggatgccaaggctacacaatggggaaaggatagtctctccaacaaatggtgctgagaaaactggatttccacatgccagaaaaagaagttggattaagaccaaaacataacactttataaaactcctagaagaaaacataggggaaaaccttcagaatatcggatttgggagggatttcttaagcatgacagcaaaagtataggcaacgaagcaaaagtagactaatgggactatatataccacgctcacaaacttccatgcaggaaaaaaaatgaaatgaaaaggcaacctatgaaatgggaataaatatttccaaatcatctatttgataagaggttgaacaggacttgaacagacatttctccaaagaaaatatagaaatggccaagaggcatatgagaagatgttcaacatcactaattatcagggaatgcaaatgaagccacaatgaagtaccatcttttccacgtaggatggccactactgaaaaaacagaaaataataggtgttgacaaggatgtaaagaaattagaatccttgtgcactgtcattggggatacaaaatggtagagctgctatggaaaacactatgaacattcctcaaaaattaaaactagaattaccataggattcagcaatcccatttctgggtatatatccataggaaatgcaatcagtatctcaaataaatatttgtacccccacgttcaatgaagcattactcagtcgggcatggcttatgcctataatcccaccactctgggaggccaaggtttgaggacagcttgaggccaggagtttgagaccaatctaggcaacaaagtaagaacctgtctttaaaaaaaattaaaaattagccaacgtggtggcgcacatctgtagtcctagctacaggctaggctatagctgaggctgaggtagaagggccatttgaacacaggagctcgaggttacagaaagccatgatcacgccactgcaatccagcctgggtgacacagcaagacctatctctacaaaaaaaaaaaaaaaaaaaaaaaaaaagcagcagcagcattattgacaatagccaagaggtaggaggagcaacctaaaagttcattgaaagataaataaacaaaatgtgttatatacatacagtggaatgttattgagtcttaaagaaattctgtcatatactataagagtgaaccctgaggacacgctaagtgaaataaatcagtcataaaaagacaaataccacatgatcccacttacatgaggcatttacagtggtcaaactcacagaaacacaaagtagaatggtggctgcctgaggcctggggtgaaggggaggggatccattgttagatgggtacagagttgtaatcacacagggtgggtggaaggagttctggggaactgtttcatagcaacatgcatgtggttggcaaaagtatactgtacatttggaaactattggagggtgagttttatgttatgtgtaaaagtttttttgccacaataaaaacaattagtacacaggaatatattacctatatacaaagtattatttaacaaccttgtattttagtcatacatctttaaccgtattagatttaaatcagcccgagcagcaaatctatttgttaaacattcatattcaattatgaaaggggaccaggtccagtggctcacatgtgtaatcccaacactttgggaggtcaggatgggaggatcccttgaagacaggagttcgagactagcctgggaaataaagtaagacccagtctctaccaaaaaaaaaaaaaaaaaaaaaattaaaaattagcatctccagtcccagctacgagaaagactgaggcagaaggatcacttgagctcaagtgtttcaatgctgcagtgagctatgatcgtgccactgcaccctagcctgggcagcacagcaagatctcatctctaaaaaaacagtcataaaaaaagaaattatgaaagggacaagattgagattattttcatattcaacatatattaagctaatattatttccagatgatttttatttctctgacctcttccagaacatgaactcccaacacacaggaacgtaggagtttatcaaaatgcttccaaagacacagattgtaaaaagagagaatacaatgttgcttgatacaaatataacacaatctacacatgtaatttaaagttttcccattgccacttaaaaaataaataaataaataaaggcaggaagatggcttgaggcccagagtttgaaaccagcctgggcaatacagtgaggcactgtttcagcaaaaaaattttaaacttagctggcacatgtcgtggcacatgcctgtagtcctagctactcaggagaccaaggcaggaggattgcttaagcccaagaggttgaaggctgcagtgagctctgatcacaccactgcactctggtatgggcaacagagcaagaacctatcacttaaaaaaaaaaaaaaaaatctactgtatggtagacgaacctgtgtatggtagacacacctgacagtgataacttaagcatacctgcgaatgaccctgtatggcagatgcacctgaatgtgcatttagagttccaagctaaggaatccaggagaggccaacccggagatccattccttaactatgaggaacatccaagtctttaccctctctcactcccatcctgtcccgtggaacaggcaggggccatacaggggatcgaggctctttgtttcgggttgaacgaaggttgccaggtggagactgttagaggagggtgctaagtaaaaatgctacataaactgcatgccttctgcaagcagttgcagttcttctgcccagcctgctgccattggcctgtgcagttaccctgtccagcctgctgccactggattcttccccgtatataaggcccagaaacaccccatgtcttgtttgctggctctgggtctcttctttggcctcttgaatctggtgccatccccactggagtcaataggagtttggcacaacagatactggtgacattaacataatattttatttaatataccaaaaatagttccactttgtagtgaatattaaaaattgagatatgttatattcttgtactcatatacttttttttttcctgtagagatgaggtcttaccatgttgcccaggctggtttcaaactcctgggctcaagtgatctacctgcctcaacctcctaaagtgctggaattacaggtgtgagctaccatgcccggccctcatactgtctttaaaatttgatacatggccaggcatggtggctcacgcctgtaatcccagcactctgggaggccgaggtgggtggatcacctgaggtcaggagtttacaaccagcccggccaacatgatgaaaccccgtctctattaaaatacaaaaaaattaactgggtgtggtggtgggcactgtaatcccagctactcgggaggctgaggcaagagaatctcttgaacctgggaggcggaggttgcagtgagccgagatcgcaccattgcactccagcctggacaacaagagtgaaactccatctcaaaaaaaaaaaaaaaaaaggtacatacactggacagtggctcacgcctgtaattccagcactttcggaggtggaagcagatagatcacttgggcccaggagttcaagactagcctgggcaacagaacaataacttgcctctacaaaaaataaacaatattagccaagtgtggtagtgcacacctatagtcctagctactcaggaggcttaggtgggaggatccctcaagcccaggagctcaaggctacaataaactgagatcacatgactgcactcccatctggacaacgcagcaagatcttatctcaaaaataaaacaaaataaaagttggtacatattttacacctatagcacatctcaattcagatgctaaattttcatttgactacttgacttgtatctagagtccaaaaaaactttacagttgaaaaggtagattcacatacccaagttgctctaaacatatttacaattttccattaattgaatcaagcctcttgtttaagtttaaaattaaatgaaatttagaattcaattctctaatctaaccacatttcaagtactcaacagtcaaatttgcctagtgactgccatattggacagcatatgtctaacaggaacaggaaaaagcatctatctcatcagttggctctatcttctccagttctctgacattgcgtttatgatggctctcgtagtatctaactggtacaggctgagattaacctcctccgcaaggaagacatttttgttctctgaaaagccatcagcatttggagtctgaacaatggtaaatgaaaatattttaagttttccaggggggtgctaaatacagattacatttgacatcccattggagtacatacagtaaatggattttaattgtaataattaattattggaaacaccaagggtaaaacctgcttaccctaattatgtgaaattgttctaaaatccatttggaatggccctgttaagagtaagattgaagaaaagtcatcccctgtcccaggtgtaatctcttctgcgggctctgggcagcaggctgataaaaaggcagcaaggagctgcaaaaagaataaactactcacctgaatgcctttgaaagactgatgggcaatatttgttgggaatttgaatattctcaaacttaccaaaacacatattttgctcaaagattttttttttttttccaaacagggtctcactgtgtcagccaggctagagtgcagtggcaccatcactgcatcctcgacctcccccggctcagctgatcctcccacttttgcctcccaagtagctaggactacagccatgcatctccatacccggctaattttagtattttttgtagagagggggtttcaccatgttgcccaggtgggtcccgaactcctgggctcaagcaatccacacacccgggcctgccaaagtgctggggttacaggcattagccatcacgccctgcctcaaagatattaacaaaaataacaataataataaaatgaggcattaggaatagtgccttcatttgacaaggcacaggccactcaaatcactgattaaattataagattccttggcaacatcagaatgagaaaagccaagtagctataatttgtgtgagccaaaacactggacacaaagataaaaatgacatcaggctttgctttctctacaaagaaacaccaacaattgttggtaacaatctctgttaccaacccagcatggtttataacaacaacaacgactaactcaaatagttcctactaataatattagtagtaataataatagctaacacatatatgccatttactccgtgccaggaactgtcctaagcattttacgtagttaactcgtttaatctgcccaacaactctagaaagcaggtactttatgcgacccattctgaagatgaagaaagtatggaaatgacagttaatgaacaaaggtcacacaggcgactggcggaagacctaaggtttgaacctaaacagtctggctccaaatggcatgcttttaaccactacgctgtacagccaagactatcaaattcaccttggctggtctgagaattataaagaccactacctactcagaccttttaatcccaccctgacagaaatacaaatacatgaaaacttctttccacatttactcaccaaagatctttgcgcagtgatccattcactgtgaccaccatctctcttcttagcacatgcgtgcagaaaatctagttccaaaatggagtcaatccaaccaaattaggaaattcctattctactcccctctgcacctcaagaatttcatacaactgaatgttgatctcaacagaaatcttgtggctcatcactcatctacaagaactgctaactaaggaattgcttctaatatcatgaactccaaacccacttcaataatgggggcatggacacacgcattaaaatctcacctacaattcaaaaactcacaatcccatcttagacaatagttctaatcccacgtaacaaggttgataatgaattgccaactatttctagtttctctactcttacttgccccaaaagctcaaagcacttcatgagagaagtgacttacaaataataatgacagaagcacccaagtaaaaggggaaaagtaaggacccagatacacagcccttccttcatcagagatgtgtatttcaccctggctttccaccctattgttcttattgtatgattccctcttttcttgcacttggatttcttccttggtgccattcgtttcactgtgtgtgtgtgttgttgttttttatttttgagacaggtcttgctttgtcacccaggctggaatgcagtggcacaatcacagctcaccataacctcggcctcccagactcaagtgatcctcccaccccacgagtaactgggaccacaagcacacaccaccaccacatgactaaatttttttttatagacagagtctcactatgttgcccaggctagtcttgaacttcctcggcctctttaaaatgttgggattacaggcatgagccactgtgcccagctgtgtgtattttttaatatgataaagcttgtttaatatgttacaaagtcttatttattttatttatttagttttttaagagacagggtctcactctgttgtccaggctggactgcagtggcatgatcatagctcactataactacaacctcctgggctcaagcaatcctcccacctcagcttcccaagtagctaggactacaggcatgtgccatcatgcccagctaaatttttttcatttttttcttggtagaaatggggtctcactacattaaccaggctagtctcaaactcctggcctcaagtaatcctcccaccttagccttccaaagactgggattacaggcgtgggccacagcacccagccacaaagttttctttaaatggccaattcggctgaggaaaaaaatactcatcgtgaaaatcaagtaggtcaatatgttggctaaaatttccaattgcctttagcagccagcagatatgaaagtaaaaggaacaatcccaatccttgagtttatttttaggctccccaagaaagaataataacatacctggtttaatttctcaagtactcctatatttgataactcactgagctgctttttgtggcctctgtgactctttaatccaatgcattccacaaagcaaagatcactttaaagcactctccccaccccatcctctttctcacaaaaggtgatgtttcattttcccaacttccttttggtaaattattacatggacctgctttccctgggaaaagtccagaagcatatcttctaatttaaggaatgtaccaaacattttgagtcctacagacccttctgattggtcatgaatgtaacaatcagcctttctcctgtgacacttttaattcaaaaacaaacccaaggcaaccttcaaagctgaaagtgctgaaattccagaatcagaaaagaaaaaaaaacttgctcattgatcaaggtgacacagtgcatgacttcagtatttaatagagtgctaactactgtatacttaaatcaacttccataaattcccaatgatgatacaaaccatttacctggaggccccaaaacataaaatctatgacagactttgatattaatttttattgaacattaacattacaccctatagacatgaacatattacctacgatttatgcagcagtagacttttgtaacctcacgaaattcatgttgttaagtcttcattcaacccccatccccctacgtgcacaaacaaatacacaaacctgctctgataaaatcaacaattacacttgcttccctctctgagttgccaagtcatcagatccacccacccggatccctttatgactgtaaagtttatggattacttatttctcacgggttttgcttcctgacatactgtaaccactttccttttataaagctctgatcaattctcagaagcatattggcagaggacagtgagcaacagtagcaaagatgtttttaggattttattacttggagtcttgtttgcaaagaactttacactcacatcagagccttcttacactttagaaatggaagcattcgtaatcctatttaacacacaccaaaaataaggttaagtcacttgcaaaagaccacccagtagatacaaggtagagttcaggtgcaaggtagcaagtgttccatctacccttttaatttcctcagccaccaaaattcaagtttttgttttttaattaaggctgacatcactcgtgtgagcagaatcagctcatcacatgcggcaccactagcagctagactctagctgctagaacatctccttcccagtttgttgttgttatcgttgttgttgttgttggggcagaatagacggtttgagagcagaagaggcgagaacagaacctatgagcccagtgataggtgtgataataaagacgagttttgagtttctgataagcagtttatttttaaggacccaaaataatctaccttgacattcctcccaagtaatacattcatgtttttcttgataacaatataactgttatccaaataaaccttagatttacttaggaaatagttttaatagaaagtttaagaagtcaaatataagactagtattaccatataaaaatcccacgtagaatctactttttctcatcaggcaaggtcccaaataaaaaaccactttcagtaatgagccttgtaaaggtacaacctaaatgttttttatatgcttatcaaaaagttgcaaggtaaaaaaataaaatttttgtctcatgaaaattcaaaaccacatacaaaatttgtatttttctaattaagactttccctacattggacatccagaaagtactacagaacatatgagaatctgatcttttattatgagtaataggtgtttcttcttcaccaccagaggtcagaatccagaattaagtccttatttttctaaagtattaaagttttatactttaacctcatgaatcttggagcaactttaaaagccacttaaaacaaaacaaaaaagccctcatttctcgacactaaatgtaactgtagaaaacagtttcacaaaggaagaagagagggcagacattctggttatttcttcccccaaaatactctagaagagcttatatgcatatccacaaggaggtaatagttgttgagtcggcctcacatttattcgcagattcaacaaaggacagctgacaagcatgtgccaggcatggtgttaggtgcccaggacatgagagaaaaaaaatccctccactcatggagaaatctgacctcaattccatctgacctcaattcatctgtaacactcattcaacaaacacactgaacacctcctagagccagcatgtttggaatgaacgatttgtctatataagatcctgctcattatcttgcctttctactgaaatagagtttatcccatgcctatgacagaaaattcatctctaaatattattctactattcactggacttcccccaaaaggctggtcaaattacttgaccttttagacattcttatcttacagatctagaagacaggaaacaacaggagcttgaatatgtaactaagtttttataactacattagaaactttccttgcctgtacaagacaaaaaataaacagcttttttttttttaatttacaattcacaaaaatagacaatcacaaccctcctggcaaaagaaaatgttcccagaatactaaatactaatttgaggaaaacttcacatactaaaatcacaaatctctgagtcaggtatttctctttagagaaaagcaaatcaattgtaatggtccagcagcttttcatacccttgataatgactagtttcttccacataagaattttccttttcctctctgttcagttccaaatactgtttgttcaaactgaatcaatttcatatttaggatttttaactggatcacactttctgcctaacatttttcatataacccctcattaaagagacattaacaatttcaatcaaaccaattccacttccttacccaaaaacttaatttcctgtacagtactgctttcatttcacctttaaaaaaatctcagttcacaattttttaaagacctctgttctctattacttaagaaaattcatagtctggcagaatatgcaccaatacaggttgttacaagtttggctactcagtttctgatggatcttctggtacataaaaccaaattacatattcaagctcctgtccctacttaaaattcatttttaaaattactgaacaccaaaaatggatgacatgaacaaaatatactcacagaatgttacaacagtccatataagatgcaataagaaagaaaatcaatgaaacaatattataaattgcacaaaactctcaataaaacaaagttcagcaaaacaaagctgattatatatactttaaacttttaactgacttcacttacctctcaatctgacaaggatacctactttccctctgtaaaatacatgggtgacaccctccaaagagcaaatgtatatagctattaagtacctctcccataatatacttagtacaaggcatcttgtttgttccgaaacctggctttttgcttttgttcttgaccatttgctcttgtacttaagtaatttattattttgttaaccaataaaatgagggtgaaaaatgactacttttgaaaaactaaattaactactttgcagatactcaaacggaagtggctaaattaataactgcctaatgaacggtggaaagagaatttaagtctgtaagaaacaataattttaatcttaattttaattattcctttctaattaattaactacaactagaccaagtagtcagctggtgtcgaattaagaagtgtttcgtgaagctaaacaaatatgataaagcatatggtggtggccactcccaatcatccccttccccagggtggccagacgagtcttcagatagcactcctcctgaaggtcatctaactgaccccacaaatcatcttaacctaatcttacactggattctctggtttattttcatgccggaaatagcattttggttgaaaacacagtttcctctgtaagtattagcctccaacctaaatttttagagctgaaactgagttctatttttttttaatagagacagcgtctcaccatgttgcccagggtggtcttgaactcctgggttcaaacagttctcccacccaaagtcctaggattacaggcgtgagccaccagacccaggctgcaactgagttcttgaacccataaagctgagaaaacataaaacttaaaatctcactactctactacattctacactgatggtctttaaaccgggctatgtataacatttagggcacatgaaaactctaaaggaaaacaactatctctccatcttcaacttccttgtaaaataatatgcctgagaatttcccttctctttcctaactgcctctcacttcctaaagtgggcatacctctcagccaccaccctcccctcatctcactaggcacactgcccacgattataaaacctcccaggcaacaaggaggagacccactagaagcaaactggtcttgatgcaaataaataaataagaaacatttctagacgtctaaaagggaacaaaatgcttttgcaagttggattgcttcaaacaaaattacaggagcatccattctttaagccatctgccaacaaatcattaaaaataagttctgatgagattactgtgtgagttttgccatataacttcagaaaaactccaaacaattgactggcactgctataatactccctttttcatttttgacaagttttttcagtgcctgcatcttacacagaaaagaaaaagggaaaataaaaatgatgccaaatcttttctcatctagtaataaacgaatttataaagaataaaacacctgtatatatgcaatagatgaatgtataaacagaaatatttttattttttatcaatcatttatcagaatttgtaatataatcatgttattttgatcaactccattccacaaatggaaatatttatacaattacttctggattaaataatccttgaggcataggatatttttaattttcagtattgatatatttttattacataagtatgacatgataatccataaaagactctaaaacatgaacatgtattatattagaataaaaagtgggggagaaggccaggcgcagtggctcaaacctgtaatctcggcactttgagaggccgaggtgggcggatcacaaggtaaggagttcgagaccagcctggccaacaaggtgaaaccccatctctactaaaaacataaaaattagccagccgtggtggcgggcacctgtaatcccagctactcaggaggctgagccagaaaaatcccttgaacccaagagtaggaggttgcagtgatccgagatcgcaccactgcactccagcctgggcgaaagagcaaaactccatctcaaaataaataaataaataaataaaagttgggggagaaataagataacaaaagagttcaagtaaacagggagagataagtttccaattaaagagcttgttcactgatttttttaatgaatggtggctggtatgacaatgttagatttttcatcagctctacttaagtatattatgtaaaaggcctatttttaaaagccaatttttacaatatgccccaaattacgtattttgaaacaacctaagttataatgacaacgtatgcaatcagcacaagatttgaagaccatggagctataccagtagcagtcggtctgcactcaatgactacgattcagaagaagaacgcaacctactgttccagtctttaactaacaacagctcctcggtttgcacctgcagttggagtctcaggaacatcatttcctccacaagctttgcactttcccacctcctggcccctgttcataccaccaagaaaacagacccagtcctcctcaaattccaccattcttccttaagcaggggcttttggtcaggtgctgtgaactgctaatttggtaggagagcagaataacatagtggggtagtggggttgagggcatggaatgtggtagcaggttacctggtttcaaaatctgcctctacaatttactagtttaagccaattaatctctctgtggtccaatttcctcatctttaaaatgggaattataatcaacattacctgatgggggtgttgtaaactgaatgaattaatatagctaaaacctttaaagccctgcttgacagtttttgccacatcatcgttattgcccccaccaaaatttctactacagtgactatcaccacacctggtccagatttttactgtgtagacactagcccacatctttataaattgctacttcctcacctatttcagggcactgcttacttgcaagaaacaaacaagaatatctatgaaccccattagtcccttcctagagaaaggcactagtgagaatataatacggtccataaaaactctgtgtaaatcaactggggttaaggaagagaaacactagcaaaggtattttaattagcgagtaattctaccctgtttcagaaacagaaaaatctagtggcaaaaagtaccgggagagggcaagtcctgggaagaaactgctgggagaaggtcacactttctattcccagggcttcattcattccttatcttgaatcaagagacaatacatggaaaataattagagggggataacctatattgataaccaaagaaaaccaaaaaataactggatagacgattgatacagacatcactgcctattcctctcctctccagttgttcaggcctacagttggctgtagttcactttttacagttggttgaaaacagaaaaagaggctgcaagaaggaagccaaggacagtactaaacagcagctctggagaacatgggctggcaggtgtatgaacacagaaccattgatttcagcgaccactacaacaaccatccccaaaatcatatcttcaggaaagaatgtttctttttaacaaatgatttgccctaataaacgcagccccatatttggccttcagaagcaattattttttgtttttgtttttgttttggtagagacagggtttcaccatgttggccaggctgatctcaagtgcctaacctcaagtgatctgcctgcctgcctgcctcagcctcccaaagtgctgtgattacagacgtgagccactgcacccaaccaggaagcatctttccaacccgaactgcaatataactttttcattgcaataaacctaaacctcacttgtgcctaaatgcaagccagcatcacatcctcagctgccaagttgaagaataggctcttatcaattcaacagcacccaaaagcattaaactcagctgagatatttgtgtgaaatacagattcctggacccctagagaggctgactcagtctggggtagagatcaagaatctgcatttttaaacaaacccccagggaattcttaagtacactgtagttttatgaccactgcctgaaggacatccctggaatatcacttagcaaatgcaattcatacttactttgcccactatgagaaactgttggcatcatttgcatcagcaagctctgtttccacaagactgggaccatgactacaaactgtttcggatttgaaacttgccagcattacaaacagaaaggaaggggagagcatctttctcatagcttagtcacagtcctggtgaagggtctgaatcaccctgacggctgcttgtctttttcactaaaaggctgaatgatgagggtagactgtagcacaatggttgttttatcctgttccaggtccacctttatggcccaggaaccctgtagcaggaaaatggggcttcatgggatatggtctctcgggaatcattcactgagcagttttgctaatttgtttttactaaaaataattttatataaaagtaaagttatactttataatacgattccattttaaaatactgatataagtattttggaatatttgtgttcctaaagagagcaaaggatactcctttgcaaaacatatgtatgagtacttttaaaagctgagacacttttaacttttgctattaaaaggaaacataaaataaacaaagcttttgttaactggttaaagtaagtggtgttcaagttgccattccagtttccaagctgtttttgtgaaagcagaggggtgggggcattttacaccagtgcaaagggtaagaatagcactccggaagaataaaacttctctttattttggcactccacattaacttatctgataagttgctgagtttattatatggggatatttatttcaaagccaatgccttttgcaggggtaggcagaggcatggtgaccaattttactatggcagagcctttggccaaatcacttcacccctttgaaatgcatcacatggcatcctttaatttgagtgcctcctccacctgagtcatgtaggataaattactctgtgctgtcaaatgttgtgtacctgttatcaccactgcctgagagagcataaaatacatattttatggaatagtcactcctgaatgttcaatatgcacaacatagttttggtaaaaagaaagactgactttctgacaaatacaaggattttgtagcagcaagagtactaacacagaagcaagtgactatgttcttaaccctacgtaaacacaaaccagactagtcattttactttgggcaacaccagatacattctctgtgccactggtttcttcagatataaaataagggagacttggataacatgattcctaaaagctcacactataaacctgtacttttcaagcagtctcaggtgttgttttctgtaccaacaaaaatgaaacatattgtgaagttgacatagaaattcattactgtctgcttattcctgctgagggttctggaattataagcctgggaaatagcaaaataatagctgccatgcataagttaaagtgaagaaaaaaaaatcagaaataacatctggatacccagacaccagatcccttcaatacatgcaaacagaaggtatgtagtcatttttaaaagaaggaggcaaaaagccacaactactattttgaaagatgatgtatacgaaaattagcaaaagaaaacatattatatcttacatactaaataagcatgatttataccaactatactgtcattcattcaacacatatttactgagcacccattatgagccatgagttggggaaaagagcaaaaacaagacaaacagttcctgctctttggagctagataaacagcaagggagtaagccaaaattaaagaatttttacaaacgtgatgttgatgcacaaaagaagtagatatagggtgtgcccgaaaacctaatagtagaagaagctgggtgtgaaggtcctcagggaataacatttcatctaagattttaaggattgtgggcggggagcattgtgggctaacaggagacagcattctatgcagagaggatagccttacactcttattaaaaaattttttattctatttttattatttttctttcattgatacataatattttacatatttatggggtacatgtgagtattttttacacatacagattgtgtaacaatcaagtcagggaatttggggtgtcatcaccttgcatgcttatcatttctacgtattggtaacatttcaaatcctctcttctagctacctcgaaatatttgaaatattagacactatcaaatgttatatctataaattgagacagtttagataatttaggtatactgttaaatgttataactgaaaagcaaagggaccagggaacatgtatctactttattttgtgtgtgtgtgtgctgcctcctgtacttttctccaggttacacatgcatgcacgcacacacacgcgtgtgtgcacaagcacatgcattttatttctctagttaacatgtatctactttagatcaatggagcactgtattaaaaattatatacactgagaccagcaggacagagcactatatatatagacaaaaaatgagggaaatcattggcacacttacatttttttctcattttaaaaatagcaatcaagatactcaaactcttcattctgaagactatccccaaaataattaatcccaaaataaattcgtgtaattaaaacttttctgattaagaaaaaactccaatcttttccagagaccacctgggcagcctcagaactattatccttctatgctaatgattgctggttttaatcatcgtccttatagcaaaagacaatcattgcattccagttgacaatctgtgtccaagtttcctttccaaagttgtctttaaagtccaaggcaaataaaaaccaccacacatggttgcttacagaactgacaagagatccttgactccaacagacctggttggcatcaatgattcaagcacattatgaaaatctccacacgactcaaagttttttaagtacagaactgaagtttacatccacaaatctgtttgatctctgcagttgcaaaaccatatggcacacagagaaaaacaaattatctctgcttatgaaataagaaccctctgtaggctttgggacagaccaacagctatgattgtcctactcgctgcgtatcactataattaactttctctgatccttttgaagaatgtagagttttggggttttggtttgtttgggtttgaggggtgggggggcagagattagggaacagaagtaaggacatcaccaaggggagatggagagaatcctaagcctaacctcagacacaataatttaaatattatctttctataaatattttatgtcatattttcatgctttatttaatcccatttatactgaggagatatataaagccatgcatgtcaacatttaccatgtaatgcaagttatgcttgtgaaaagggctattatactaagtgactcagtagcttccatagtaatactagtttcacaatcactataagtttccagccattggctacacagaaccaaaagcaaaaatataccatgacagtaattaaaaatgcggttgaattctgctatcgctgtttccactcccaccactacctctaccaccaccatcattcatgcaatcctcaccaaaaaaaaaagtttagaaataatttacacttctagctttgcacctcaaaagtaacatgtaaaggaatttaaaatttgatctatgacactaacagattttaataaactacttcataaatataaacaacccaccaatggacccttagcaccagcaaagataatttcagagacaatttggttaagcaaattcaaaagtgtaataaaagaaactgcaaatgcaaaaaaagagtgacaagaaaaaaaggagtaaatatgtttaatggcagaagaatcatttcccagatacatgtgcaattttatacattaagtgtttttaggggatgaccaggtagaaataatttatcattttgatttcctaagagaagacactattcttaagaataagaggctcagtagccctgcctatctttctgcctggtaagaccagaaaaatgaaagtgtttccctaatactttgtgtagtataacaggtgatacagtagttaagactggcttcaagtcttaactaatcagagttgtgaaatctcaaaaacactaggtcccagagcattctttgcattttgtctttattttacttatactgtacccaatgaaacaccttctaggaacacctaccgtcccccattcccatccagtcacagctcacagccctgctggcttgctagcttagatctcataaacctggagctaagagctaagaagcacagtaacctatcagagctgtcagacatgctggggaaagtttccaagaagcacactaggcagaattcaaaggaaaaaatttatccctgaagctctgatcaactccagacataaatatctttaaaacatatggattacaagcacagtcctgggaaaatcagtaacatgtcgtggaggaacaacattaatgggtttacctggaatctgatctgctaatatctaaaacacttttttttttaaagatcacttgctataacaggtgaactaagaataccttttattcactatctaatcttaccgtcctaaagccaggtccctgctgggtagggaggggtgtcatatatttgacaaataataattgaaacagccttttccttttctttttgttgacagtctattcagacaaaccaggctaaatacatttccagattcccttatgtgcacaaggagagaacagctccataaaggtccacagagacatctggaacaagcagcatctctacctgctaagcataaatactgcttttctgccttcctggatggtgcttttaatttctcttacaatcctaaagcctctcagctgggttagaaagcccattgtttttttccctttatccttcagtgaaggccttgtctatacctcttggccacagacagacagaacaaagagtagtcagacctacagatttctgtacttgaccttctttatgtgggaaagacgttggcgtccaacactgctataataagaaaaaggaaagtgagttgcaggaatgacaaacagaatctgtaaaagaagaaaaagaatcagccacaagttttcattatccaacttaggatataacaaaagatgacttttaaaaataaataaataagcaagtgaatctagtcaggatagaaatccatttggcaagtaaaatccatctccagcacagcatttttagagcagcatgctggagttttcatgttttgaaaaatgagacactgactaatacacttagccaaatattctaatctgtcatcattctaaatatacgggcctatctttcagcaaacaaattagcaggtaatatatcatccctgagtgcatacccttccctggatgctctataaatacagagtgatcaagactggcagttactcagtgtaaaatgtaaaacactactaacttcacttaagccacactgcagaagtccatcatatcaatcagaagcagggtgtcagaaaagtttcatgcacttgaaattcttccaggggagggaaaatgaggagacttagaaaagagatggctcttacactccctttatttgatcatggagaaaagaagaatgaatctctggaaataaatgactcctgtatgtttttaagtgtgtctaggatcagatgagcaagcctcgaatttggcaaaattgcaaactaaaagaaaaaatagcctttgcgttctccagcctcacctactaaaagtaattcaaagtacataagcttcccaatacagtaaaagctgcaaagctagctatagtctcaggtcctcagaaacaactcatgcattttccaagattctgatttaaacaacaaccaactattttctgagggcaaaaggggagtaaagttcttaaatcatttaattctgccaattagttccgcaactatggcattaaagaactatggatatttatccactggaagtggatcaaaaagtgggctctcttaatgcctattaaatagtgctgattttcaagcatcactgaccaaggtcaaatctgaaccaatgtgaaaacctccacttccccatcactaatcccttgagccatccattcttccacaaggcaaatgttttgtagtcaggggagaaataccacacggtatgggtagcacttaatatgactggtttctacattaaactcagcttacacgtcttccatttatctgtaaaaagttagagaattaaaacacactggaatctttcaaatatgatatcactatagtactggcatatacagagaatcaaggaattaactgctttattccacatatattaggtaaaatctctggtttactgactgatatgttttttttttttctcagtatttagttttctcccaccaattggaggaataaaaggatgccccactgagtatttgtttacaattgacaagattatcttctgtaagtgtgttactgatcaaactgtacaatgcacaaagcttcggttccgctaggttatcagctacacttagaacagtttgggctaaggagttgggagggatgaggaaaacacagtgagctgtaatgcaactgtgctcttggtggggtgcgcacactgcgaataacttaccaactcactgcccaaaaaggaaaacttctagagtagcccagtggacccaaggacctaattgttcactttctttatagaaccactgctataagtactgtcctccccactctcataatctaatacacactgctaggtaattcaacttaatattcccattgaaacaaagttagtcacagtccaagtctacagttatctataccatgagtttttaaaacatgcccaggttcactgaaaacctaaccacgaattacggtaccttttcaaaaatattaaatatattgaaactaatatattccaaatccccaaagaaaatatgattgcattttacctctccacccccaaggaaagaaaagctgtggtgccctgagacctagactagataagctagtcactaccaaaaccctgaacataaaaagctactctgtccatcgtgggcacattctagtccctcttcagaaaaagtccactctctatatcctcacttcctccttcctcctactcaaggaaaaaatatatatatatttatatatatatatatttatatatatatatatttatatatatatatttatatatatatatatttatttatatatttatttatatatatatttttatatatatttatttatatttatttatttatatatatatttatatatatatttgtgtatatatatatataaatatatatataaagtgtactttcatcacatggaattaaccactttcccactgtatttttaaacactttttgggctgagcatagtggctcatgcctgtaatcccagcactttgggaggctgaggcaggtggatcacttgaggtcaggagtttgagaccaccctggccaacatggtgaaacccagtttctaccaagtctacagagtgagactccatctcaaaaaaaagaagaggggatgtgaaggacccttctgccccctaacaaaataaacacttattgtacctatcacaatgcatgttctttttaattgcatgaacaatacacgcttaggacaagttcaaacaatacgtaggcatattcagttaaaacagagtcctctcctctccctccaatccctgctaaccatttgttatgtatccttccagcctgatttatatacttaaacacgtatacatgcttatcagtttacagatctagcatatctaacagactgtgcactctataagagcaagaaatgccctattcacctgtgcatccagtacctggcaccctgctgatacaaatagttgctcaataaatatttactcaagaaataatcaaacggttaaagccacagagaagcaggtcttctggggacttcagaaacaaggagaaacacatgtctgtgtccttacatatgcttgtgcccatgctcatctgagattaagaaggaggaaaaagggtagagggcatctgaacctagggctccaggtggtacaccaaatgatcactggttagccagcacaaggatacggaggaatagcagcatatccatctttaaaaaataataataatactcaaagcaactgaccaaagagggagatccattaggattctgctatgtccctgatctcaagggcagtcttattaactgtcttaaaggcaccgtccagcaaccgcatataggattctcagggtatcaacctcagaatagatcatttatggattagaaagtgggtctgaattgtgtttgaatatttataactcattttagaaaaaatgcagaaacttcaggatgcaaccaaaagcacaagaggaaatgttatcactcaaagtcaaaaaaaaaaaaaaaaagtagggctgaaaaaattaaaattaggctgggtcccttttctccaagaatctaaattaaacgtgtttctataaccaaaagaagagctgaaagtagtactatattcagtaaaaaaaaaaaaaaaaaaaaaaaacacaaacgatttaaccaattaatatgcaactcaatatagaagtataaattctttaacttttttaaaaggttattagccttgctgttgcaatcaagccaccaactgatagccaccccaagctatagtgagcctaaacataaaatggcacaggaaactcttctatgtcaaactctgttttagtaaatcttcagatttgaacattgaaatttcatttaatttggcttatcatcacagttctccttttccttgccagggttccaagaaagcgtaactgcaagatttggcacaagaaactttccacaacttggtcaacagccctgactatattatcattacccagatttatagaatggtcccagtgaccaagacacagggtacatgtccaacaataatgtatattttgaaatgaacaaattgatttatacattaaccaaacaggtttttggctcagagtcaagaagggctacatacactaacacttggcttctaaccctgaaactaacaggtcttcattccactggggagcaaggggtttaaaaaagagaaaggcccatgtttcaagaactcttctctcttaccctccaccccactcaccaaaatacttacctccatccccgccacctacagctgccttcaggaacaattaagatgttgacttggagtccatgttctgtggctattcaataattcccaattaataaaccttagttaagaagaatatggtgacagaaataagtactcataaataaagtaaaagaggggtgtgtgtatgtgtgttagaaactgtgatacgtaacattttaaaagcatccgccactgagatatttatagattaaaagatttgatgtctaggactgacttcaaaataaattcagtcggagagagggaggaaaggaggcttagatggtggtattgatgacacaagattgtgagttaataattattgaggctgagtactgaatacacagagaattatactattctctctacttttctgaatatttttaaatttccataatacaaggctggggaggaaggactgaaaacttaaaataaaatgctaatacctcttaatggagggattatggataattttattcagtatgctttttgacaagaatcatattactttatgttcagaaaatatttataactagcataatgattctacaaaatacttctggatgcctttagaagccattctaatacaagcaaaccaagctgtagcaagatccaagcttaagagaaaactacagtcccctgaggggtacacacccaaaaatccatataaacaaagtttccagtgaggatgtaacaagtatagaatgaaaagaatctgacaaaaatatcccaacagaaagtaagacaagttaatttcttttcctgaaggaaaatatcatctgtttaacaaggtttatttcccctttcagctaatgttgattaagtccttgttatgtacaaaaaacttgtctgtatttacatctaatcctcactacagtcctgagaggaagttattaccttcatttcagaaataaagacattgaggttgagagagtaaaaatagagtggggttggagtagggattccaagaatttaagaatcacatctttgtctttaagatgtctcagagaaaaaaaataggagagaaaattcccaaacacaaagataataattcatctacttcaaaaaattcccaaaggaaaactatccagagcctcaggttccaacgtaaccctatgtgagggtaacacttacacccctcctgtccatgctcacgaccaaggggaacaaatgattgtaaaaggaatacatcaagaagaatgaaaagttccataagcctcaataagatcaacaacagcagccagcatttacagaatgcttacttatgtgcctcccatggtcttattcacatacacactaaaggaactcttatcgttcccattttataaaaactgagactcggagaaaccaggtaacctgctccagatacctgctagtaggcaaaaactgttttcgagacccagaaagcctccatgggttactgcacacaccattacccaatgttgtaccttgaaatctaggctcattccctctttaaaaacagttatagcaataatagcaatcatctatctacactccccaattaacaccccacaaaacagtcaccaagatgtcccaagacttttcaaagtctcagagctgttagaaagactacacagaaatctactacaacatacttataatatgcttgatatttcaaaaagtacacaagccaatgacgacaacctataataaaacttcagcaaacaagcactagggaaaactcagcggtgtccttggtatttagaacacccagttctaaaggtttggagtgaagagaccattccaaatcccagtttctccactcacaagttctatgactttgggcacgtcatctcttagctatttcagtccctgtttagtggagctaacatacctatgtatacgtaaagctcagtgcttgacactcaatgtgaagcagaagctcagtaaagtcttcttccccacctaatgcgctgtggtctgtacctgcaaacatcctttctcctccaataaccctagcagaaaaatgaaccgttggctcctcatttgcccccagctggcccaaactacattccctccactctgacaacacaacagcatctattctataaatgaaagatcctcaaactgtggggatttagctcagtaacgctattttgcaattactataattttactttattggactttcagatgggctttgtttggcatttgattatttcagagccaatttcccacttaaaattctagaccttggctttgaaaatagagtatgaaaaatgccaggatattatattgtaagggacaaaaactgcatgagcagccagagattgttttatttatacagtgacaacagtcagaattccaaagaatcaagtcatagaatcttaattttcttccgtcagcattactagcatggtagtaataaacaacaacagcagagtcaaagtactgtgttttttcaaggttattcactaacacttaagagaaatgaaactaaaattaatatggctaaacataaacactacactttctaacaaacatggaaattatttctcctacatgtatcacagttttaacaatttcttaagctacttacatcaaactatttttgtttaaatgagatttctggaatgtctataacaacaaaacagatttagacatatgtacatttatgacatgagtagaaaatgaattgtgaaccttaccaatttttgtatttgtcagaaccaaacatttaagcaaaatcaaaaatccaaaggtccaacttttatgaacactgttaaacgattaactttcaaattacttagaaattctggaaattcctagcaataccgattgttcttctttaaaaagcaacccaataaaataagaaacctataggtctggattaagtcccaacaaattccatattttcttactttttttgactctaacttcccacttagaaaaggcagggttaagaactaaatagattctgacctttaagcataacttgaaaaagccatagcctgaagatgagtcatacctagactttgtaaactaactacacaattgctaaactgtatttcatacaaaattaagaagccatgagtaaaactctaggctttatcactcactgaaaatagaagacatgtctttgtagtatagaaaagcacacagtggcttagttacacacagaaaaaaacaaggaccaccacgtgtactcacacatatacatatcattccttgggaaacaaagatttattttcatataatgctgcaggtgagcttataacttccaacaaaagcttttaactttccaacaaaaaccttttaactgcaacaaaagcaaaactacacaatgggattgcctcaaactaaacttctgcatagtgtgcacaagcacatgcacacacacacacaaacaacacagtgaagtgatgacctattaataggagaaaatatttgcaaaacctacatgtaataagagcataatatctgaaatatataagcaactcaattcaataacaataaaaaaaacctgattttatgtatttttttactatactttaagttctgggatacatgtgcagaacatgcaggtttgttacataggtatacacgtgccatggtggtttgctgcacccatcaacccatcttctacattaggtatttctcctaatgctatccctcccctagcctcccacccccagacaggccctggtgtgtgatgttccccatcccgggtccatgtgttttcattgttcaactcctacttatgagtgagaacatgcagaaaacaacctgattttaaaatgggcaaaggacctgaaaagacattctaaaagacaaaacaaatggccaacaggtatgtgaaaaaaatgctcaacatcactaatcattgtggaaatgcaaattaaaaccacaataagatatcatttcacttctgttagaacagtttttgtcaagagaacaaaagataacaagtattggcaaagatgtggagaaaaggaaatccttgcacactgttggtgggaatgtacattagtatagccattttggaaaacagtatggaagttcctcaaaacattaaaaataaaacaatcacatgatccaccaatttcacttctgggtacatatccaaaggaaatgaaatcagtatgtcaaagagacacatggatgaacctagaggacgttatgctaagtgaaataaaccagacatgaaaagacactgcataatcccacttgtatgtggaatctaaaaagtcaaactcacagaggtagagagtggaatggtggttaccaggggcagggacagaggggtggaggaatggggagatgttggccaaagggcacaaagctgcagttaaatggaaggaataagttctggagatcaaataggaagctgaccacggttaataataatatacggtatatttcaaaattgctgagagagtagatattaaatgttcttgccatctcaaaatggtatgtgaggtgttggatatgttaattagcttgatttagtcattccacaatctataaagctctcaaaatatcacattatactccaaaaatatatagtttgttatttatttatatattaatacaaaatattaggccaggcatggtggctcacgcctgtaatcccagcactttggaaggccgaggcaggcgaatcacttgaggtcagggattcgaggccagcctggccaaaatcgtgaaaccccatctctactaaaaatataaaaattagctggatgtgatggcaggcgcctgtaaccccagctgcttgggaggtggaggcggaaggattgcttgaaccctggaggcagagattgcagtgagccgagattgcaccactgcactccagcctgggcaatggagcaagactccacctcaaaaaataataatatataaataagtaaacagtaacatccagatttctcagttaattaggtctagaaacagaaaatttctgaactacctttttattagttgaaagaaaactaaaattagaaaacctctccttgctcaaagatgtgttttctccatccatagatatagtttctccttcaaaaaattatacacttgcatataaaatgaagtacctccagattactgactaggagacttaatgaaatcatttggtttattcacctgttgatactttcatatctcccaccaagtttgaaaactaggtcaaagtaaaactatcacaacaggagaactttttttttttttcgctgttgtgttttgtttttgttcctgtttttgtttgtttttttttgttttgttttttttttttgagacagtctcacttggtcacccaggctgagtgtagtggcgaaattactgctcactgcaacctcaaattccagggctgaagtgatcctcctgcctcggccccacaaatagctggaactataggcacatgccactgtgcctggctaattttctgtatttttcataaagatgggtttcaccatgttgcccagactagtctcgaactcctaagctcaaggaatccacccacctcagcctcccaaagtgctgggattacaggcatgaaccactgtggccagccacgaggaagattttaaaaaccactaagacataatacaaataaaaaactaaaatggaaatgaatgaagaccagaaaagttaaagaaaatgcaaataaagttaatgtttaaagtagatgttaaaaagctttaataagttaaaagatgtctgaattataagatctgaagcaatttaagagaactaaaaccaaaccaggttgggtatacgtctccccttggtaaaatggaatcatgttgctacctccaaaaaggctttgaaaaactggaacataataaaaacagtgttaacagtaactaattattgagctgttctttgcacattacataaaccatctattgcatttaatcctcatcaaaacccaaaactataaatttttccatcttacaggtgagaaactgaggtacaagacagatcaagttacttgctcaaaaataaaattctgttgcatttttgctgtttggtttcattttttgggtttgagaaagtatagaaatagaagaactggtgactggttactcctattaaggagaatagtaaatcacttcatatcaaagttcttaaacttgaaaatcaaaatcacctatagggcttgttaaaatgcagattgccgggttctggacactacatccagggtctctgattcagtaagttcaagataatgtccaataatttgcatttctaacaagttcctaggtgataatgcccggactaactgcaaatcacaattaagagacccactgctttataccaataaaaaagaaacatgacaaacacttagagacacaataaaagaagaatgaatcatgttcaaaggaacctaattccactgtctgaattttccagttatttgatttataccacacattttaaagaacaaaagttctgtgaaaagtcactatggtgtaaagtacaatcatacctatgagatattgcaagttcattgcaaatgactgaaataaagtgaataccacaataaagaaaatcacacaattttttgggtttctgagtgaatttaagagttacatttacactataccatagtctattgagtatgcaatagcattatgtcttaaaaataatgcatagaccttaattttaaaaatgctttattgcttaaaaaaatgctaatgatcatctgggtcttctgcaagttgtatctgccacatccatcccctcattttgctagtggagggtcctgcctggatgttgatggctgctgactaatcagggtggtgggtgatgaaggttaaggtggctgtggcaacttctggaaatatgacaacaataaagtttgctgcatggattgactcttcctttcacaaaagatttctctgtagcatgtgatgccgtttgatagcattttaccacagtagaacttcattcaaagctgaagtcaattatctcaaaccctgccgtcacttgatcaaccacgttatatgtaatgttctaaatcctttgttgtcatttcaacaatgttcaaagcgtcttcaccaggaatggtttccatctcaagaaatcacttgcttggctcttccataagaagcaactcctcatctgttcaaattttatcatgagattgcagcaattcagtcacatattcaggttccacttccaattctacttctctttccaccacatttttagtgacttcctccacggaagtcttcaacctttcaaagtcatccatgagggctgggaaaaaattcttccaaactcctattcgtgttaatgttctgacctcctccaatgaatcacaaatgttcttaatagtatctagaatagtgaaccttttccagaaggtttccagtttactttacccagatccaccagagaaattactatctatggcagctatagccatagatagcaggcttgaatgtcaaaattacagatacaactcgcagaagacccagatgatcattagcaatttttttagcaataaagcatttttaaaattaaattttttaaggtttgtgcaaaatttttatttcctgtgcatttataatgtatacattcataatgaatttcttaaataacaaaacttgaatgtcaaaattactccctgacccacagactgcagaatagatgctgtgtcaccaggcataataactacagtaatttcctcgtgtatctccatcgagctcttgggtgatgaggtgcattgtcaatgagcagtaatattttgaaagaaatctttttttctgagcagtaggtctcaatagtggacttaaaatattcagtgtggcaagcagatattgtaagtagatgtgctgtcatccaggctttgttgttccatttatagagcacaggcagagtagatttagcataagtcttaaggacactaggattttcagaatgtaaacgagcactggcttcaactaaaagtcagcagctgcattagcccttaacaagaaagtaagtctgtcctttcaagcttccaagtcaagcactgacttctctctagctatgaaagtcctagataacatctttttccaatcgaaggccgtttcacctacattgaaaatctgttgtttagtgtagccaccttcctcaatgatcttagctagatcttctggataatttgctgtagcttctacatcagcacttgctgcttcaccttgcacttttatgttatgaagatggtttctttccttaaaccccataaaacaacctccaaactattcttctgcagttgcctcacctctctcagcattcagagttgaagacagttaaggccttgctctggattaggctttggcttaagagaatgctgtggctggtttgatcttctatccagaccactaaaactttctccatatcagcaataaggctatttgctatcttatcactcatgtgttcattggagtagctcttttaatttccttcaagaacttttcctgtgcattcttaacttggctaagtgtttggcacaagagatctaggttttggccatcttggcttttgacatggtcttctcactaagcttaataattctagcttttgatttcaaatgaaagatgtgtaattggcttaatttcaatattgttgtgccaggaaatagggaggtccaaggagaggaggagagatgagacaatgactggagcagtggagcagtcagaacatacacagcatatatctagttcgccatcttatatgggcacgcttcatggcaacacaaaacaattacaatagtaacatcaacgatcactgatcaccataacagatacgataataatgaaaaattctgatatactgcaagcattaccaaaaggtgacacagagacataaagtgaacacatgctgttggagaaatggagcaaatagatttgctcaatgaagggttgtggcacaaactttcaacttacgaaaacacaatatccagccagatgtggtggcacatgcctgtagtcccagctagtcaggaagctaagtcatgagaatcacctgagcccacgagtttgggaccagtctgggcaatatagtgagatctcatctcaaaaaccaaatcacactatatctgcaaagcaccatacaatgaagtatacctgtactttattttcaaaccaggagtaatcctgcaacattgtccaatgtctattatcttgacctctaaaaatcccaaaacatataactctttctacctgtctcttctaaaattatacactgttctgtgtggtgatttatcaccacacaaatttaatatatttaataactccagttaaagcaatagtaggacaacatttcaatttagtattgcttccctcctatttttaaggccctgaatgttcagatgcacaaaaaaatcatgaagtaggctagacactaacctgatatattcacgtggagttaggctctgagatctttcaaaacacaacataataaagtttgatccaggagtataaccatttgtttttatcttttcagatgatatgaatctgaagaaatgccctccagagaagaaaacacaactttcatttcacagcgcctgttctcttaacccatgtaccttttcaacatctctgtgaaattctcccagcaagacaaagagccccaggttcagcaaagattcaccttgaccatctctcactttcataccaatataccaaccacttgggcaattatcacagacttgtccattcaaatccattctagccccattactgcacaatagaagacagacttctgccagacacagccatgacagattcgaaaggtagaaataagcactgtggggtggggctgtgcttctgaataaatcctagtgtttagttttcagcttcaagggagaagagtgaacacacacaccattttgccagctaggctttagggtcttgaagtctgctgctgtgataatggaagactgctcatgtgttcagcttcctgattacagcagacatagcagttttcctggctggccagttctatattatttgggaatcattcctagaaatttaacctaaaacctgatcctccagtatcctctgtagttcccagtatcaaatctctccctgctaaaactggctaaagtggtctctgctatcaacaactgaatccagacctacatactactaaacagaaaaggattcctttaagttcctatcatttgcaaaaggaaatactccaccacaaagggaattattagtggctggcatgatagaagagatagacaacaatttggaggatctgtactacagtcagctcttctgctgaccttgactaaataagaatgtaagaactgctagataaactcaaaagaagtccatgtaagtcctcccttccctagtcatatctggcacataagatgtattaaaattttgaatcactctgaactaacatctattctaagtattatggaagcataatgaaaaacagggattgattactaatccagggctcagtttcattatctgaaaatggggctgaacgtggtggctcacacttgtaattccaagactttgggaggcagaggtgggaggactgcttaaagccaagagttcaagaccagcctggtcaacacagaaactacgtctctaaaaaaaaagaaaaagaaaaagaagagaagatgggaaacatatcaaataaagaatgacaggtcaagaacactatgatatctaatacagcaaccaccaggcatacgcaactactgagcacgtcaaatgtggctagtgcaactgaggacctgcattttaaattatattttattttaattaattaaaaattttaaaatatgatcaattactagaaaacccttgaacattatattgggaacaattcaagtatatgacgctaacattttccaagtagatattttatgaaatctaaatacataccagattccaaaggcttcaccaaaaaaagtgaaatactttattaattatttatagatatgttaagtgatattttggatatattcagttaaataaattatattgttaaaattaagtttacttgtttctttttactttttcgagtaaagctactagaaaacctaaaattgcaactgtgacttgcattatatttctattgtacagcgttgcttaccttaaggaatgtaaaacatttaacaatttttgaaagaagggttaagaacaggataaatcaagccaggtatgatagctcgtgcctgtaatcgcagctcctgtaatcccaggctgaagtgcaggaggattgcttgaggccaggagtttgagaccagcctgggcaacacagtgagactacgtctctaaacaaattaaaaattaaaatttaaaattagctgggcgtatgcttgtggtcccagctactctggaggctcaatgggaaaatcacttgagcacaggagtcaaaggctgcaatgagctttgagtagtacgccactacattccagcctgggcaacagagtaagattccatctctattaaaaagaaaaaaaaattaagaaatgagaagaaatgaaaattatatatatacaaaagaacaaaacaacttggtatcatcgagaaacaagaggaaatgtccttctacaaagagcccatgagaagacttttttaaaaacatctctccaaataagatttctaagtatccaaataatttcttcacaattctgacgcatgaataaaaaaatataaacttttaaaaaacaagaagttgatgagagccattatggaggcacacaaaattaatttcctatgagaaagtaaagtatggtatgaggaaatgtggacttgtggttagggtaaaagagctctttgctctaaccccaccctttttactcactactaagtccaaatcaagttagggacacatatgagaggctagacaggacatggtaacagcataaaggtgaggcctccagcctggtgatccacagagctcagtatgggatgcctaggtagcaaagagggagaaaccttttgttttctctagggggagagaagacactgggtgaattcagaccctaaagtagaccccaggcagatttttgtaagtaagactaattaaatctcaccagactcgtgtgaggtaaatagggagcagtgaggtcctatcccagttacactaaacaggcccattaaataaagaaagccatagcttcttaccaccttagcaagacccaagagctctggctcagctaccacagtctcacagtacaaaaagtctactcatcttagtcattcacacaggcacaaccccagccatgctaatggtcataaatgcaaatgctatccactactttactctttcttccttgggagcatttaattagcattaactcttaaaacaaaacagaaaggttaaatcccttctctccatttatggaaattaataataatttccattgctgtaactagacagtgataagagtcccatctaacactttgcatgttacgttagttaacttgacttttttttttttaagctcgatttcttagagaaaatctcttgaaaaatacccttgcacagacatgctccaacttctttcagtcttgaataaattcagactgggactcaccattggagagccaagactcttcataaaacaagttcttagactctcttggacagtttttttaatccatttgctttgagcagttttatctggaacctgtgcacactctgcctataatggttagtcctgaagaagaccaaggctgctaatcaaaaagtgactagggatggaatgacttgaaatataatatagttttcctttcacataggcatggcttatcaatgttttcttcacacactccttcacaaacatggctagaggtaaagccttgaaataaagcagtcaaaattcatttttgtataaaatatttactgtattagacgtagcattctaatcatacacagcaatgtgtaaggagagcacccctccctccagttcagaggaactgaaccagaactacaacaatttacacagggctaacctgcctaaccacctgaacagaaaagcctctgtcaacatattttgtttttaaacctacattatattccaaacaagcaatgcatgccaagctacactgcatttggtaatttgtacaaaaggatattgccaaattccaatacaaaatgactatgaacacacccgtttattttggtgcttctttaaattccatttatcagtggattcatttatagtttaggactgctgaacgaacctttcaagaccatgtttctttttggaggataaactcaatctgtcttaaatatagcaaagttcaacaattcagacattgctgtttctcaagttctttgatacacaggtgagagtggtaagttagtgtttattttaggatcatttatggtaagtgggagtgggaagagatttttaagcaagaaattacataaacaaaattaaagaggtgttaaacaaattctttctttccctttagaaatttaatttacatactgacaatgtaaacaccatccacagcagtactttgatctgctaattacaaaacatttttatcttttcattaaatcaggagttctaagaggccactttaatgacttaaagggcaacgtaaataagtcttccctaattcacaccagaaattcacttggaattttttttcccttaaactaaaggatctatgcaattctttaactcttgggatggttgactcctgtatagttgattaaaatattcaacctgtttaggcccctggcagccaatcagagactggactttgaggattccatccacagttgatgaagcaccttaaactacctctcatataagatgcaggaacactatgcaattctatcaggtacaaggaaaacatttaaaattcaacatttctacagagctaatccttcaatttggtaagaggaataccattacctctggctatttctctaagtgatcaacaacaacaacagaaatgcatttaaggctctatatcactatttaaggagagcaaccctctctcaggtttaaaagagcctaaccttttctctcctatttttgaaaccacagaacaaagttctatatctgatgctcaatccagccgcaatgaaaaatatttttaattttttatattaaattattctccttacaaaactaaggtgaatccaaaatactcttttaaaaaaccaataagctgtactttttaaagcagttttaggtttcagaaaaattaagcagaaagtacagagagttcttacatattccctctccccactctacctggctctcattttcccctattattaacatcttgcattggggtggtacatttgctacaactgataaaccaacattgacacactattaactaaagtccatcccttacattagggttttctctctctgttgtacggaagttctatgggttttgacaaatgtataacgtcatgtaaccactcataacagtatcaaaaaaagtagtttcactgccctaaaaatcccaccatgttctacctattcgtcccttccttcctccccaccaaacccccagcaaccactgaactttttattgttttcatagttttacctttttcagaatgttataaaattgaagtcatataatatgtaggcttttcagattggcttctttcaattggcaatatgcacttgtatcagtcctgtttcaccctgctgataaagacatacccatttcatgctgctgggaagaaaaagaggtttaattggacttacagttccatatggctgcggaggcctcagaatcatgataggaggtgaaacacacttcttacatggcagcagcaagagaaaaatgaggaagaagcaaaagcagaaacccctgataaacccatcagatcttgtgagacatactatcgtgagaataacacaggaaagaccggcctccatgattcaattacttccccctgggtccctcctacaacacatggaaattctgggaaatacaattcaaattgagatttgggtgggggcacagtcaaactatatcattccacccctggcccctcaaaatctcatgttctcacattttaaaaccaaccatgccttcccaatactcccccaaagtcttaactcatttcagcactaacccaaaagtccacagtccaaagtctcatgtgagaaaaggcaagtcccttctacctataagcctgtaaaatcaaaagcaagctagtcacttcctagatacaatgggagtacagacattgggtaaatacaaccattccaaatgggagaaactggccaaacaaaggagttacagggcccatgcattcaaattttaaagctccaaaatgatctcctttgactccaggtctcacatagagatcgtgctgataccaagaggtgggttcgtggtcttggacaactctgcccctgtggctttgcagggtacagcctccctctctgctgctttcatgggctagtgttaagtgtctgtggcttttccaggagcactgtgcaagcagtcggtggatctaccattctggggtctggaggacagtagccttcttctcacagttccactatgcagtgccccagtagggactctgtgtgggggctccgaccccacatttctcttccacactgcccttagcagaggttctccatgagggtcccacccctgcagcaaatttttccctgggcatctggcatttccatacatcttctgcaatctaggcagaggttcccaaacctcaatccttgacttctgttgcacccacaggctcaacatcacatggaagctgccaagtcttggggcttccaccctctgaagccagacaccaagatgtacgttgttccctttcagccatggctggagcagctgggacacaggacaccaagtccctatgctgcacacagcatggggaccctgggcccagcccacaaaaccactttttcttcctgggactctgggcatgtgatggaaggcgctgccatgaaggtctctaacatggcctgaagacattttccccatggtcttggggattaacattaggctccttgctacttatgcaaatttctgtagagggcttgaatttctccccagaaaatggggttttcttttctatcacattatcaggctgcaaatttttgaaacttctatgctctgcttcccttttaaaactaaatgcttttaacagcacccaactcatctcttgaatactttgctgcttagaaattttttctgccagatatcctaaatcatctctctcaagttcaaggttccacaaatctctaaggcagggcaaaacgccaccagtctctctgctaaaacgtaacaagagtcacctttgctcctgttcccaacaagttcctcatctccatctgagaccacctcagcctagactttattgttcatatcgctatcagcattttcgtcaaagccattcaacaagtctctaggaagttccaaacttacccacattttcctatcttcttctgagctctccaaactgttccaacctctgcctgttccaaaatcacttccacatttctgggtatcttttcagcaaagccccactctactggtaccaatttactgtattagtccattttcacactgttgataaagacatacccatttcacgctgctgggaagaaaaaagaggtttaattggacttacagttccacgtggctgggaggcctcagtatcatggcaggaggtgaaaggcacttcatacatggcagcagcaagagataaatgaggaagaagcaaaagtggaaacctctgataaacccatcagatctcacgagacttattcactatcacaagaatagcacaagaaagaccaggccccaagattcaattatctccccctaggtccctcccaaaacacgtgggaactctgggagatacaattcaagttgagatttgggtgggggcacagccaaactgcatcagcatttaaggttcttccatgtcttttcgtagtttgatagctcatttcttttcattgctaaacagtattccattgtgtggatgcaccagctcctccatttacctattgaaggacatcttgattgcttcaaattttgggcagttataaataaagctgttataaacattcatgggcaggtttctgtgtggacataagttttcaactcatttgagtaaatactttggagcatgatttctgaatcacatgatgcattaatctgttcaggttgccttaacaaaataccataaacttggtggcttagtaatttgtttctcacagttttggaggctggaaagtccaaaataaaggggccaactgattctgtttccggtgaggactctctttctgacttgtagatggccaacttctcaccgtgtcctcaaacaaccggggggcaggcaggcctcttttcagtctcttatttttcaactgacaaaaactgtacatatttatggtacacaacatcctgtcccttcttataaagacactaattccatcagatcagggtcccaccctttaacctccacaaaggctctatctacaaatacagtcgtagaagggtagggtttcaacgtatgaatttggtaggggcacaaaaacagtcagtccacaacgtacagtaatagtgtgtttagttttgtaaagaaccgtgaaaccatcttcaaaagtggctgtgtcactgtgcactcccaccagcagtgaatgtgagtccctgtggatccacatccttcccagcacttgattctaaatcttcaccattctaatggtatgtagtggtatcattgtttttgttaatttgcaattctctaatgacgtgatattgagcatcttttcatcacttatttgccatctgtacattttctttggcaaggtgtcgcaaaatactcttttcactgttctatttcccagtgtggtctcatggtcatcttggagcatgatcaccaggactgcttattagaaatgcagaagattgggctccaaccagtaacaatatattaagacctttctaatacagtcaagaataccaaacactaaacagactgctataattgagggagaaacagtgaataagaatcaccaatggtcagcctgactcttactggatggattggttagagacctgcaaccattatcttttcctcacgggctgctgacttttcaaccagaaagcctcttaaagagaataaatataggccaggaacaatcactcacatctgtaatcctagcacttcgggaagccaagatgggagtatcacttgcactcaggagtttgcgaccagccgggcaacatagcgaggcttcatctctacaaaaaaaatgttttaaattagccaggtgtggtggtgtgtgcctgtagtcccagctactctggtagctgatgtgggagaactgtttgagcccagatggtcaaggctgcagtgaaccatgatcgtggcactgtattccagcctgggtgacagagcaagaccccatctcagagaaaaaaaaaagtaatatggatgggtatggatgggtactgacataatcaggaaatcaaagtcattctgtgactggaaagaaaaaaaaaaaaggagattgaaaattgacgtttgcccaaatcccaaaagtgatatcactgacttcgtacataacccctagaaaatcactggggggcttaggggtggcagtggactggttctccttaaaaataagttcaactaacctgctgaaaaagagaggcagaagttaggtatgcagctgggaaactgagataggcaaaataccatggaggcaaattattcaaactatggcaggtcacaagtcaaactccaatttaaagcccctaataaacatcaaggagttttttttttttacctctttccaagggaggagaggaatgaagggaaaaaaagtagagaaataatgagactcactggttagggaagtggggaaatggtttcccattcctctaaggagccagcagaggggagcaagttgggaggagaaaaaagagcaaaaataagagtaagaaagaactattcctagtataataccattttcaatctatctgctacatcctttattttgttttttttaaaaatgaaatgaaacctcaatctgtttttaaaacaaaagcatgattctttcctaagtagaagatgtgatgaattaattttcctcaaactttctaggtaggagtcaggagaagccagccaattatttgataaaaccaagtacaaaataaaagacttgattctgcagcttaaaataatgttaatataccaatttcccttagatttttttaaacaaaagtttgatattttaatttttgcatatttccaacagatagcagatagctaggccaaaaaaaaaaaaaaaacaacttcccaataggttcatatctgcaaagggaactttcaaagaaaccaataagacacaaagcagataaaaatgacatatcatataatctttttctttattcactcctattatcactattctatgaattaggtaggagaagcccatctgtctctcctcattttacagataagaaagcagacactcttggaagtgacggaaactttttcactgcatggccttcagtgcataagagagccaaaactcaaaccaaggactcccacctccaagacaagagaggggccccctactctttccacttcacaataatgcctaaattctaagataaaagaaaaaaaaatactcattttaaccattaaaagaaaaaaatctataatgtggctttcaaatacagagaaatcctttattgaaaaactttttggctgcataaatgtcttcttttgagaagtgtctgttcatgtcctttgcccacttgttgatggggttgtttgtttttttcttgtaaatttgtttgagttcattgtagattctggatattagccctttgtcagatgagtaggttgagaaaattttctcccattttgtaggttgcctgttcactctgatggtagtttcttttgctgtgcagaagctctttagtttacttagatcccatttgtcaattttggcttttgttgacattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaagtttgtcaaagatgagatagttgtagatatgcggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaacgttcttcgatttgtttgtaaccccttttatttccttgagcagcggtttgtagttctccttgaagaggtccttcacatcccttgtaagttggattcctaggtattttattctctttgaagcaattgtgaatgggagttcactcatgatttgcctctctgtttgtctgttgttggtgtacaggaatgcctgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaacaaacacatgaaaaaatgctcaccatcactggccatcagagaaatgcaaatcaaaaccacaatgagataccatctcacaccagttagaatggcaatcattaaaaagtcaggaaacaacaggtgctgaagagcatgtggagaaataggaacacttttacactgttggtgggactgtaaactagttcaaccattgtggaagacagtgtggcgattcctcagggatctagaactagaaataccatttgacccagccatcccattactgggtatatacccaaaggactataaatcatgctgctataaagacgcatgcacacgtatgtttattgcggcactattcacaatagcaaagacttggaaccaacccaaatgtccaacaatgatagactggattaagaaaatgtggcacatatacaccatggaatactatgcagccataaaaaggatgagttcatgtcctttgtagggacatggaggaaattggaaaccatcattctcagtaaactatcgcaagaacaaaaaaccaaacgccacatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataataaaaaaaaaaagaaaatttttttataaaaaaagaatttgagaattgaggtattcaaaaactttgtatttcttgaaagtttcttctatgatggcaatagtatcccagcccatggttttaatcggtgatttttttttttttttgaggtggagtctcgctctgtcacccaggctggagcacagtggtgcaatctcggctcactgcaacctctgcctcctgagttccagtgattcttctgcctcagcctcccaagtagctgggattacaggtgcccgccactgtgcccagctaatttttgtatttttagtagagatggggtttcaccatcttggccaggctggcctcgaactcctgacctcgtgatccacctgcctcggcctcccaaagtgctgggattacagcccgacctaactggtgatttgtaagcagccctctgtggagctgagttacccgccaggagaagccattctgtggataatgaacagcccatttacaaagtcatctaggtcagctgttagaagttggaaaatctttttctacctttcctttcaccaaccactctaacttagtaggcttccagagctgtaattacacacatttcaatgggcgtcaactctctccaagattcttaacatcctagaagtcagggtagatgaaaatggcagttgtgcctccctagaaagcatgagttcatgagtcccctttacatcagtgctacccagacagagtccctatacttactgctgatatgggttgcatgtgtcccctatgtcatcttgaattgtaatccctatgaatctccacatgcggaggcagggccccagtcggaggtgattagaccatgggggcagtttcccccacgctgttctcatgatagtgagttctcacgggaatttatgattttaaagtgtggcgcttcacttgttcattctctcgtgttcattgtctgtctgtctctctctctgtcactctctcacctgcctgccaccatgtaagacatgcctgcttccccttctgccatgattgtaagtttcctgaggcctctccagccatgtggagctctgagtcaattaaacctcttttctttataaattacccagtctcaggcagttcttcatagcagtgtgaaaatgaactaatacaattgccgtcttcttttttttccttagtggcattgtcttgctctgttatccaggcttgagtgcagtggcctgatcatcatgcactgcagcctcgaattcctgggctcaagcaatcctctgacctcagcctcctgagtagttgggatggatgatggacatgcatcaccatacttagctaatttttttttttttattatttgactgtagagatggggtcttcctacattgcctagtctggtcttgaactactggcctcaggcaatccttccacgtcaacctcccaaagtgctgggattaaagttgtgacccactgtacctagccttgacagtttttaaaaagaacacaagggacatttagtcacattaacccacaatcccaaatcaattttagtatatacctagtggcattctgaatttattggacctattttttgaatctagttttattgttctctccaatttatttagtatgtttttttctagtttactgggggcctgacacttaggaagaagagtaagttcctgccactactgtacagcagaggtgctgcaatttgggcactgggggtgcatttaaaaattcacattcccagatttcactctgaaaaggttcccagtcaataggtctcagatagtgtggaggaagcatttttaacaaaatatgactcgactgtagggggcattctcagaggtgtattcagcaaatgcagccacagaacgactcagcctggcccacaaaatgaacttataaacagatatgttaaaaaccatctgtgaattctagaagcctataaaaaaggaactgattatgagtagtgaacaccaaaggaattccagactgaggggaacaacttaggcagagttatagaatatcgcgaaatgtttagggaacaaagaatcacctgaaaattaccaaacttacatgcaaactgtgaactcaccatttagggagcatcttgaatatgaaatatttcacagaaagaatactttaagagaaaggtgtttaagcagataagtgaatgtgtatcaaaaaaaagtttttgtgacaaccatgtgaaagatggtttctaaggaacatgaaactaaaaacagaaaattaattcccaaatggaaaagaaaggaagagtgtttttaagaaatgttaaacagaatgaagccaggtacggtggcacacttgtagctagtcactcaggaggctgaggtgggaagatcgcttgagcccaggagttcaagtccagcctaggcaacacatttttttaataataaaaataaattaagaatagaatgaataagaattagtgagccgccaacctatattatcatattttcattcccaagtgattaagagatcagaaaaagataaggcaagcctatgagtaaacattctacctattccaatcacatatcccaaaaaattaaaatggaagatgaaaaattagacttttagcctcacaatccatccttacttaaccctatcatctcccctaccccaacttacatgtggttttagatataaaccagaataacctgcttacctatgcttactccttcactagagctgctataacaaagtgggtttaaacaacccaaatggggtggcttaagcaacaggaatttatttacagctctggaggctctaagtccaagatgaagatatcagcagggctgatttcttctgaggcttctccttggcttacagatggctatcctttctctgtgccttcacatggtcttttcttggtgtgtctgtcctaatcttctcttcttataaggacacaagtcatattagattaggtcctaccccaatgacctcattttaccttaattacttctttaaggattctacctccaaatagtcattcttagaacttcaacatacgaatttgtggtgcatgggtagggggcacataatttggcacataacattataactggctataatttttataacttaaagtaatcattacttcaaaaactttgaaaaagtcctaaataaatactcacaagcaaagagaaaaacacactcaggtctaaccagatccctcctagaatgcaggtgcacttcagccatacgattaccaggaggtctattccaacattccaagatcaagaatcagttccaaaactatcctgggaattttaagccacttcctatgagcaacaaaatttcagacaagttcctttctcatccatccccactgataaaactaaagaagcaatgaaagagaaggcaagggcaggtggagtttatatagtgacattccaacacttgctaccaaagctgttaagtattattatggcatttttgatgaccatgcccagaacttaataaaagctcaaatttttctgtactgtagctaaatttactatagcagaaatttcttctgagatagcatgactcttcagaagccacaagcatatttaaaataaaaaaacaagggcttcaatattgtaaatttaaatggccataaacgtctgactcaaatccgtttcttcccttggaaccacctcctctctcctcagatctcaacatttaaaaattaatgggtgtgttcactttctgacaggcccagaaaccccaagttatcctgggacctcgagaggagaggaatgtacacaaacttatagatatttgagggcagaaacccgttgttgggcttagcatcaagaaagtcttatctgagattccttatgaaaccatcaaagccagttttaaaagcctatgtgaaaaataatttttcttgctgcactttatacaaataatcacgccaagtataataaagcagatcagttttaccatgatttgtctttagtaaaaataggacactggagagagaaaaattatgtttcaacaactatggtacatctgttattagattctagtctcattcgttgtttctcagtttttttcctgcaatttaaactaactctgcttattcctgtgaaccaaccagtgatctctggctgtgactcagaagaaacaatagggatgggtaatgtaaaactctgaggcagtattttaattctgggcacgtactggaatcagccagcaacttcagactatcagcttggttccaacaattgcataattcatagaaagccttcttattattttacttaggataactttgcttatttagctttactcttgtagaatacattgttgttgtactccatgtgtaggaatgcaggataagcttactcaatgttctcatttttttttttttttctgagagggagtcttgctctgttgcccaggctggagtgcagtggtgtgatctcggctcactgcaacatccgtctcctgggttcaggcgattctcctgcctcagcctcccaattagctgggattacagacacccaccaccacacctggctaattttttgtattttagtagagacagagtttcaccatattggtcaagctggtctcgaactcctgacctcaaatgatccgcctacctcggcctcccaaagtgctgggattacaggtataagacaccgtgcccaaccaatgttctcttaaattaaacatttattaatcttctagatatcacctttcgttggaactcaagagttatgagtgctcctcgacatactaatgctttctgactgagctcctctctaccctgaatacaagagaccctaataggcaggaatattatcacctctattcagcctgaagaagttacagaagatggatcttcatccctcttcaacccttaggattaagggttctcttataaaagggaggggggcaatatgtcagaggtgtttgaaccagagcaagtccatgttgaataggggctgggtaaaataaggctgagaattactgggctacattcccagaagattaaggcagtcttagtcacaggataagacaaaaggttggcacaagacataggtcataaagaccctgcttacaaaacagactgaggtaaagaagtcagccaaaacccgccaaaacccaccaaaaccaagaaggcgatgaaagtgacctttggtcatcctcactgctcactatatgctaattataacgcattagcatggtaaaagacactcccaccaatgccaagatagtttacaaatgccacagcaatgtcaggaagttcccctgtatggtccaaaaaggagaggaaccctcagttccaggaattgcccagccccttcccataaaactcatgaataatccaccccttgtttagcatataatcaagaaataaccataaaaatgtccaaacagcagctcatactgctgctctgcctatggagtagccattcttttgtttctttacttctctaataaacttactttcacttaaaaaaaaaattactgggcatgggggttgcagggtgccgtggctcacaactgtcatcccagcactttgagaggccaattcgggaggactatttgagccaaggagttcaagaccagcctaggcaacaaagtgagatctccatctctacaaaaagaagaagaaaagaaaaaattagccaggcatggaggtgtgtgcctgtggatccagctacacaagaggctgagacaggaggatcgcttgatcccaggagactgaggcagcagtgaatcgtcttcatacataccactgcactccagcctgagtgacagagcaagaccctatctcaaaaaacaataaaataaaataaaaattactggaaaaataaggttatattactttataatttatattataattttatattaccacatacttcactaagttatccataaaatcagacacaggaaacatttgtcacaatataaaattttgtcaaaaccataaacaggaaaaatagaatagatcctgtatctatcatttgaaacataagcgttatcaaagaaggaaaatcaccaatttgcaaccccaataaaatagttaattcaagctcatcaaaaaaagatcagcagtagatgctaagaccattagagaaaagattattgtagcacatgacgtttgaaagatacaaagtgtcataatgctagtagcagtaaccacaaaaaaagaaagacacgattttatataaaaagtcttatcagattcttttcctctactttttatccctcacaaaagcacatatactatctgaatcccactgtaaaaagaagtccgggaaatctgttaccatttctctacctagctctgtccaatacggcagccactagctacccatgactgttaagtcctcaaatgtggcaagtgactgaggaattaaatgttttattttaaataatttaaattttaaaagccacatatgtctagtggctattgttttagacagtactgctgcagggtataaacaaacctagccatgaaagacaatataaaaagtcacaagcttaaattatgggcaggcttaagggaaaacttgaaaaacttataaaactattttataagcttttatcaccagataattctgtatcaggaattgcctccattgaactttcttatagcatgttttcttgactacaaaaaataaatgctgaataaaagcttgcggaattaaatttataaagctttaaacctaccccaaaacactgaattaccaggaaaactatggcatttaattaaatgtataggagtaccctgatttaagacgtccctattttcatgactgatttttaaaaactgatttgcagttttcatttaaaataataagctctggccaggcatggtggcacacgcctataatcccagcactttgggaggccaaggcaggcggatcacctgaggtcaggagttcaagaccagcctggccaacatggtgagaccttgtctctactaaaaatacaaaaaattagctgggcatggtggtgcatgcctgtagtcccagttacttgagaggctgaggcatgagaatcgcttgagcccaggagctggaggttgcaatgagctgagatgtgccactgcactccagcctgggctgggccacaaagcaagactccatctcaaaaaataaataaataaaataaaataataagctgcttgaaaacattaaaaatgtagtctcactcacaaaatattattatgggtcccttgcaattacacattaattttaaatcagcttgtcaatttacaaagaagccagttggagttctgactgatagggactgtatgtaacctgaagcaatttgggggagtattgccatcgtaatattaagtctcccaatccatgaacatggaatattttttcatttatttaaatagtcctctatttctttcaacaatgttttgtagtttcacagcacaaatttcacatctgttttgttaaatgtgttcctaagtattttactctttttgatgctattataaataaaattgtttccttaatttcattttcagattgttcattgcaagtacgtagaaatactatctttttatactaatcttgtatgctataaccttgataaattcatccattatggggatagtacaggtagtacctcaattcatagggatcattagactaataaggtaattattggagagtacccagtactcagcctggcacacagtaggccactgaagtacttttatttatctagggccttacaaaggtgtcttactataaagttgttatttaataccacttatgtgcaaaggtctgagtaacacagtgacttaaaaaaaaaaaaaatcctgtccataaggagctagaggtcttactgcagaaatagatcatccttgtcccacaagtaatttgtatagacatcatattaaaaatctgaataagatttcctttacaacaaatttaccttcatatactgttaagagcctcagaagaccatctacttttcaaccatacaaatgaggttcatccctccttcttcttactatgtttattactagattcttccataactcttctgaacaccagtattactgcagagtggtgtcatgtattgcacttgaccaataagataagaaagttttagcgtcttgtaattactagctttgttttttctttctgtgaagcctatttcatgcttttgaattttcagaagagaaacaaaaagaaatggaaaataaaaggagtaagagattacaataagtaaggttcctatagaactgcagtcaccaattctgccattctatagaagcttactaatattttttaactaaaacaatttttttccaaatagttctttaaacttagatatctgcttagtgttccaaagcaccatttaaaatcaaccaggtcctgtttctgtctcagcaacatttgctttacttctaaataattgttaatttacatttatttgttggaagaaagacagccacaacctaacaaaccacaatttgtgccacaaagtctaatcttagcccagatctatttttggattcataacagcttgagctaaagaagaatttcattacattgttcaagttgggtcataaacagtctctgaaaagagaagcaaaccaacataaaatgctgtagaaaccaaaaatgatataaaatatgaaagattcaggttcaaacatctgctatataaatggaaacattactgtgctcatcttcaatctctacttaccactttatgttcccaaaaaactccgttcctaccaaactataacttatttaaattacactgaaatttatccacttacaaatctatctccccttcgccccacatatgagtctctgagggcagagaagccatatgtctaactagatgtgtaaatttggaagagaagtaggatgtgcaacataaggcatttccatcccaccccaataaccatccaacctgtaagttctcaaaaatggctttagttttgcttttatcattctaacagttgccattagtcattctttaggtgaggacactacagccttcagtgaagcactgctcagacagtatataagacaaatgacacaaaacaaaataaagttatctaattaccagaagtgatgatcagtaaactgaatccatctaagttttagctaatttacctgatagacagtacacttctaaaactacctttatgaagtgctgagctatttaagtgaaaccaaataaaggtgattcactcaaaagctgtccagaaaacctggtggcaatgctaatcaatttaagcaaatcacaacataagtttccaattttcttttccaaattagagttactttcctcaaaccctattctgctgctttaggcttctgattaggttaagaaagggaaacaaaaattaaagggaaaagcacaatattcaatgattaagagatgtgccaaatttccacgtatccagaggactcaaatcattagaattttctttgagtaggccaggcgcggtggctcacgcctgtaatcccagtactttgggaggccaaggcgggcagatcacgaggtcaagagatcgagaccatgctagccaacatggtgaaaccctgtctctactaaaaatacaaaaattagctgggcatggtggcacgcgcctgcagtcccagctactcaggaagctgagacaggagaatcacttgaaccagggagatggaggttgcagtgagccaagatcgtgccactgcacgtcagcctgggcgacagagtaagactctgtctccaaaaaaaaaaaaaaaagagaattttctttgagtatcatgcaatgatgactaatatttataaatacaatcctaagacataaagttcctcaaatgccttcagaatttctgaaggaaaactaaatcacattctgaaacaattagtaaccagatgtttaaaaaaaaaaaaaaaaggtagcatgaaacctctcatgtttctccccattgtccatggtaaacataaccaagaactgaatattgtactaagccagacttaggcctcagaatccttctcattagaccaacctaaaagtagagatatgacctagaagcatggtataaacagagtaaaacagtgatgagcttaggacttggagtcaaaaggcctgagtttaaatcttagttatgccactctaaaaaagggtgactatataatctatcatccaaagagcaatagttctgacaccaacacaggacaataggtatatacttggactgtcctcagcaaaacaggacatagagtcaccatattcataggccacatggaccatgggcaagttagttaatcttcagtcttggatgccacgtctgtaaaataacaaggtgtaaaattaaaccttcagtaactataaattgcttagctttcttcttttttcacctatataatattatattgtacgatgctaacccagtgagttcagaaattgcaagaacactgcacttatacagccttataaagagaaccctcaaagagatgaaaatccatctttgacagattcaggataatttttttaaatccacactgattctctttcttatcaaacatttcacttgcaatgttgtccaaaaaaaaaaaacaaaaaacaaaaaaaaaacacttagttcaaattctgatacctgggcagtactaaacactcagaactctgtttccacagcttcatttttcatagcttcataaaagcactcatcttgttgtgctgttattgtgtttgtgtgtatggaaaacatgcctgatgccagactaagcatttccagaaggtaagaaccacgtctgttttgttgctatcctccatgtttactgcagtgcctggcacatagatggtgctcaatgttggctgaataagtaatcaatactttagaaatacaaccccttccttaaccaaccccaactggtgtacattctcaacccatgaaaatattctgtaaggatgtatccttcttttcccatctgagtgttcacactcctcaggaataacagcaatccaaatgtttcttctctatagagtgatgtcacctatttcccgattaaggaacccaccttgaaatccaactagattttaggcttttgggagattcccattttaaatccttactcagaagcttctgatccttcacacaccatcttaaaccttactcttctttcaaagccagaactgactgcctgaacacccaattatctccacccatttccacttcttttatcctaccccagtgaactattttcatccagccataactatagagccttcccctagaaagtaaggtatacatgacatagatcactctacttattatgggagaatcagaatccaatgggaaaaaatttaaaccaaagcaaattaatacagtcaaaattcaacggcaccttcaatggtaaaatggctttaaattgtgacaaagccccaggggtccctaaggcatttctagggtttctttaaataaaaaaaaagtgtagtcaatcacagacatgtttgctttttctctgcaccgttgcccccagactcagattgctctaggggctggggtttggaggcaaaacaatgaagcatttgacaacgtcaaaacgtcagaatgacattctggaaacaaacttcactttgggctacccacttaagtagagacataccatgatacactgcccacctttagttcagaatattctccaggtgagaggaacaaataattaaggcgttttgtattcaaaaagatgtctctggcttccagatcaaaaatagtcatagaaagtagaaagtttattctgcgtgtttctaaaaaaacacatgaaaacttacctagcaaagtctcacacttcactataataaatgatctgcaactgactgtggaaaatatgtaacttttatatggaaaaatacttagctgtagcaacagcagactgttcttaccccaagctaaataacaacagcaatatgaaactgtaaatgtctactaagatagagttggaaactttgtgactccactatccctcctcccccagagtttcttttgctccacaaaaataattttagtcagatgggaatagggaaaaaactgcaaacagaaagaagtgtagtttcaatgtgagtacaatattgagtgtcctgaaagcagacagatcctcaataatgtagcttcaataaaaacttcctaaaccctttctttttttgttcctttgagaaaatgaagcaatttgcatttacagcttagttcctgtttccaaaatatccctttaactttttcttttctctttttatggtgggtataaatagcaccaaattgtcaaatcacagctattttgtgtgctacctatacaaataggtctgatttctggccagtcataaaacaattactgctgaattcctctggctctttgatatccagcttgtccaccgggcttcaaagctagactccaggacttttcttggggcactgctgaaaaacaacctcaacagaaacacagaagataaaatgttcccactcctataaacacacaaagatataatcccagaagtaaaacaattcagcagcactgtggtgggttcttccccctcacgataatttaagagtacaagtattttaaattattttttagcgatatgaatcaatgagaacttcttcccgctaactcgtatggctattttctccattttcaagcctccaaaaattaagaattactttgctttcagagaaattttctgatttactaaaataacttatcccatgggaacttactgggatggaatgaaagttcagcttcttaagcacataaataactatacagcatagtatttattcaatgtagcaaaactcattcaagctagaagctttcaataaggttaaatgtggtcagaatttcaataaaggaattgtatgtatgggcaaattatatgttttgactataaattaacagaactttactctcacatggcttataaaaaaatctacatttgtatatgggatatgtgggatgggcacatagacacacaaacacctaacccatatagtacacgcatgtgctcaggagtgacagtcaaactatttcctgttatcccactgcaaaagcaatacatttattacaaggaagtaaatgttaagtcctcatagagacacttagaatttggcatcttggaggagtggcaaatgtaacatgattatcaaatctcctactgccaggctcttgtaacaatgttttattaagtttgatacacacacacacacacacacacacacacacacacacagcatatgcacacatatatttatttatctccacctaaaaagagaaagacatgtcactttttaattcctcctgccaatggcatcatgccaaatcaatttttccttaacccagtatttttggcagctttatcataatatgccataattccacaaattcagtagttggctaacatgtggctctgaattaaaagtagatatgatatagtctccctctatatatgaaagatcatttttagatatatacataaaataaagactacctttgcacctaaaatctgcctctaatttctccttctcactttctctttaccattagcaagaatcaagcacttttgaaacattaatccagatctgattttggcagtcttctataatcttatccaagaaaccacttggacatatttatccaaagacatatagccacattgtttttcaaaatctatataataagccaactcttataagtatataggttagccttctatttataaccagaaaacttagagccacctgtttcagctctgatctcaagaacaccacttttacctcttaggtcaaatctggcacccgcaacttagtactaaatttcctcaaaataatgtgattatgtaatctctcaaatttcattatgttttttcctctgaattttgttaactaaggccaaatgcattaacatacaacaaaattctcaatgtgagtgataaaaatgcattaaaagtaacccttaatctatgctattaactgattttattctattttggcacgtttgaagtaactcatctaaggattagttaggcttttctacacttctttttatcaggactctaccattcttgatttagttttgagagaaaagggtttgcaaaaactataataatctcacagctggagatggctggaaagtccgttagtactcattgtgcccttaatttgcaggaagcctttgtgctcttctactcctcgttttacatgctgagcagttttcactgataaagtacttatagaccagttattttagattaatgaaaagcccactaaaattttatgtacagtggctgtgaactttctctttaaaatactgaaatttatcttgagagtcttgattacatgaaaatcttaaccctggtaatttgcctcaatagttttcatgtgaataggcaaaggcagtcttaaaattgtttaagaagtattattttcaaacacagaaggtatccaaaatttcaggctatgaattcagattgaatggctgaagcctcagggcaaacacactgatttaatcacgtagcagtgggtttcaaaatcttgccctcttaagacttaacaataaagtatttccctgccctttaaatctatagcaataacgcaaacacattatacagaaggacccaacattgttgaaattttgttgggatttttaacattatgacatcaattccaggagtacatggtattattctaactctacacttatccaagatgagattttaaagtcaatgagttagtatttcctctgaacttcaagcctaaaaatgacatttaaatatccaattatcaaggattataagtcaaactcaattttcacagttttctaaaagtcttcagatacaaaaaacaaagtctaactttaaacagtctaagctgaagtttttaaatctgtcccaatataagcaaaaatgttgagatttgttatattccaagacatgaaaatataatcatgttaaaattactcattttctgctatactaccttcctgtaaatcagaaattcaaatcatagtcatatagattcatataaaacacagctagcatatctgcaaagtagaaatgatagtgtttgaaactaatagggttaaacaatttattttgtgaggccactggcaaaacctacagcagctgtctaactttgcctttaacgatcatagcaaaagctcaaggaagtgatccaatgcagcactggtctttagtaaccagatcgtttctatttcattttcagccaacggaatggataacgaaaacaaaattatgcctcagtcagtacgtttacttgacaagctaatttttaacaatgttaaacttttattcacatatatggccagaagtaagttgtatcttttttctgtgtagataatcttaataacttttaaatactggctacacaagataaaacttcagatggctatcacttctttaaactcacttataaaaactactggaaaactttttagctattcaagaacatattaagctaaaaaataaaaggcaaatggttagtcattgctgtaaactgttgagccatagatgtttgattctttcagtgaagaaaactgcaggatttataccattttatagaagacctaaaacaactgtataatgatttttataaaagaaacaaactcaattcctcaaggattacaatttcctaccaaaaactacttacactgttcaaaataaaccaaaaatagctctctcattacatatcatcatctggttactatcaatgtatctgagatacctattcctacattcttttctacttaccctgtggaaaacaggtatttcagacatctagctaattgggacttataaatatttatttatttataaatcaagtgtctgaagaatgtgaataacggaaacaaagtaatttaaataagtgacccaacaaagttatgcttattagtctagttaataaccacgggttcatactagaaagaagctccaaaataatttcaaactaagttatgtgggaatagatatgacacaacattccccatttcaatatttatgatgcatatgtaactatattgtcttactcaagtaattcgcctaaagaacaattttaatccagtatttaacataattccaatcatgtttacttccacaaaggtttgggccagaacaattttagtcagattttaagctagtataacatttatactatatgccataggtaagagatactaattgattataaatatatcaaacatactttctgattatgagtcctatatcatcattttataccatcttaagtagaagaaatctcacttcaactattaagcatttgaagacaattactaagtgttggttttgtaaaggagtacaaattacttaacatttaataattaaagtatgtgcacgaatggatattcctaaactgacacacttatgaatggcttactggttttaaaaagtaactcccaaatgctgggttaatatgtttcactttagggacttaaaccatacttcttcaaataaaattaaataaattagtttgcaagtaattaatgacgagaattcaataacgtaaaactatccctgcgtattctctatggctgggaaatttagctggttatgttcatataatacacttagtgggtcttggagcccactgcctgtaaaatctcccatggagattcaagaccacccattgaaaatagaacattattgcctccagcaagaagctggtacataggactggttattcaagtcttttaaatactattttattgagggattgcaggaggtgggggaggggtgaaggcggattcatgagtggatgggggaggaaaactcagaaaaaaacagtaatttctaaagcagaggttcctgccgtacccccttcacccacccgtacttttaaaacagctacataaacaaagtaataagtgctcaatttcagagagaattacattatactccatttgaacaggctacaaagtacttttatttgaaaagctgcttgtgctctgttataaacaattttactctgcaccaatttcagacaagagaagatggctagggagtgtgggaggtggagttaggaaaaattcactcagtgtctttcaatgccttaaacagttgatccaataaagatcctttagagaaaactttaagtctattttttttctccaagtaagcaaatcatacaggagggcttttcttttctagggtactgcaccctgtctctttaaattccaggcctgccccatttcccacgcattcaatgaaagccccacgtttgctggcctccagcccacaatgtcaagtagttctcttgctattgaatttcaagattattcttttggatcatttgccctttagttttaagcacaccaaagcaaaaataatgtctttctacaataacataaagaaaactcagaggtctttacaagtctacaagtagagaacaccttgtcctctggttcctctttcactgcaaaatatgctcccactccatatgctccaaataagggccatttgtacactatcgtcatctaccatagttttgtctgtcctataacaaaattttatgagtatttttatttaatttggtgccaatttggaatctctttgcaatactcaaaccaggtcttcatattgctcaaactctccactcttcaacttggtgtctggggtatttggttataacaagttttaaaacaattacttaattttaaaactattattttatttttgcagttaagacatctatataaattaacttactaataaaagcagcaaataaacattgccatctgtactcattgtgccaaagagtatattttcctcattcttgtatacaccttaatcctgaagaagggattccaggccattatcaatcacatttagaattctctcaaaaggaatagacatagttaagcagaaatttgtcagcagaactaaattaagttcatggaatataatcttattccaaatgctggcaaatagaatttgaagttgcaattttattcaagcagctaataagaaatacccagatcataaacatcattgtttatatttcacaaacattctaaggtagagttaatctatttgtattttatggattttgtaaaatcatctactactaaagggaaaatgcccttatttttatttgacatatagctttgctatgcattagtgcacagtacacttttaaagtttaatgtcaaaatgcaaatgtgttttctcacggactataaaatcatggacttaattagataaattttagattgcagagagacccttgagacaactaaaattaacctcctcattttgcggaaatcatttttagttatgcttaaggaatattcatatcaatctgcattgtatataaaacataaaattatgtactaatttccctttgtaaaaacctctagttatttttgtagcttatatatgaaatattaataaaatcatcttagtatcaaaatagtttgaatttatggaattatgcatgaattctccatccaaaaaggaccacttctttctctgccctaaatctttttttctctatgccttatgtttggtacttgttttggtactttttatttcttaaaagttcatgtttaacttccaaattatatacaaagatgcacacattggaattgagtcttttatttccaattatcaatactatttattcttcaacataatcaccatatatctaagcaacatgatgacagtctttttatttgtagttgatttttaaagtcagatgtaggctctagaaaaatttttaacactacacagcaagatagacatgttaattatcaaagttatcaaaactccacaggaaaaaagggccagaacttttcaaaacattcctaagtactccaaaaatgtatactgtactgatatattacacatgggtatctttctgttaccaagactatcctatatgaatacacatttataaatcaggttaatctcattacttttataacttcaatacaaaatgttaagaaaggtaagaacgttatctacatgtctccctttaaagcttacgatcaacttatgaaacattgtgcaaatactcatagtaacattaaaggaaaagactcaaaacgacaaggtggcaaaaatgtcaaatagcaaaatttgaaaatgtttcttgggaaagacagtcttaatcatgttccaaattacttgtagaaaaaactaaaaatcttattgtaaatgtgcccatacatacatttaaatactagttttactttcacataatatgagtcattcaagaaaacttgaaaaagccaacgaattttactgacaacaataagaagttcctgatatcccacgtcccagagatcacttatattaacattctacgatagtatttcttcccatcttttcagtgatgtatttttatctatcacatacttctcaaaatgtggggtaaagatgaacaaatctagccattctaacacagaaaatgaactgaatcaatgatgttaacctaaaaaagatactctgtcaagaagcattaactataagctattgtttagcctttacaatgtaagaaaattcctatttatttgcagctctattttaaatgtctgcatttgtgtatttttggataaattatcggctctagtcaattgcttgacaatttcctttacagaattggaatgctaactaaaattattttttctttgacctaaaagttatacagcatgttacaactgaagagtagaaaagtacttgcttttcaaaacaacttcaattcagcatttgaattattaaatagaaaaccctatttattcttatatgtatgtatgcaagtatgttggatgatcaaaaatttcatatactttcttctaatctgttcacatgataatacagacagccctcaattagcttacatgggcagtcctcaattattactctattgataataaaaacacaagtaatatctggtaagtgatacttcagaaaagcaaattaagtgacacaatttcaaggtctattttatgtaaaagacaaaaaagcatgaaaaacccaacgatctaatggcatggtcaagagccataattgaggaagaagtttcctatcaacactgggtggtcttctgagttcttgaaatgctccaatctacaagtaatagttgatggttgaggtgaatggcaccgatatgatcagaaattaacttttacaagtgtaacttaatcccttatttggtgaattactcatgttatcttctacttccctattactgcagcaagtctttcacccatttcactgtccattcaccataagaaaggataaaattccaatacactgatgttcatatattggtattttattttctcaagaatatcattctccgaactactacttaggaagagtcagaaattaaatactccacatgtctattgtctagcatgataaccaatatagctatttaataaagggtagttattatttcattgttataaaaacactagatcaatgacaattgcagaatttatcctttttaaaactaaaggaaaaacagtattttcagagctgcaaaagcccacacagcttattcagtccaaacacatcctttctacctcccaggccagggcctttcctgccacactgctaaatactgctcctaccagttactggaattacattagactcttatttttaaagctaaaaggctggttgtatttcatggattaggtagtaaaaaaatgatagagctggccaagtccttcaagtttgtgtctagcttttctttttaagcatccaaagtaagtgaagaaagaataagggaaaaaagagaaaagagaaaaattcatttttgcctattacaaatgctagaacacattctagaaaatgtgattctcagcagacacaatgtttcctgctaaattcaagtggtggttctgtttacacaaagtcaattattagaggtgcagaagaaatgagtttcagaaatctgagtaataatttataacttacaggagtggaaagtaaagccagggattctaaaaccctttttctgacttgcaatacctgcctttatacggttgccaaaaaattccagggtcaagacattacattgatggagctataagtagtatctacagtgataacataggtcccatcctttctgatgtgtaactctaatgcaacacaggaggaaaaagagataacatatacaaagagaagggagtgttggtctaatgaaagcatgtaacacataacacgtgctgctttggtgctccataaaatgagggaagttagcttccagcccactagttactatttctgtgcatacagagaaaaagtcatacaacaagcatcagacaatcttgaactgggtcaacattttcaaataacgtgttccactcaatgcaactaaatctcaacagcccaaatcccccatgtttcattgactctataaaacagctgcttattatagagaaacagagaaataagtaaaatgaaggaaaatactatgtgaaatagaagaatgtttcttcaatataaaaaaggtcgtaattatttagctttcattattcatattaatgaagtatttgtggtaaagggtaaagatgatataaagtctacaatgaacctggtttttaaacacccaaagtgttttacatgtttatcaaatgaatagatacctggaataatcagacagtattctatccccagtaccatccttggagggaggcaggggaaatgggacataaaaacctatctgcaaaaatgaaaaggcatcattcagacaaaatttatatctgaaaacattaagaggcaaattacctccctactctccaagccactgctattattattaatacttcaggaaactgttaatatatattttgcttttaaaaatcaatatacacacacagagcattttgcctggtattgatgaggaaataactaataatttctactggaaaggaacaaagaaaaaaaatctagttttgacaaaatcaaatattttaaaatagaaaaaaattaacttggctttgagaatatcaaccttctaatatgtgtaactaattaaaggtaactaattatatttataatcactaatgaacactattttaaagataagccataattttctttaataaaaaaaatggtgacttgattttatccaaaaagttaattgttaactgctacataccaactaaatcacacccaaatgctggccttatctttttagaaattctatcgtaatagccttcttcagtcgtcaaccactgcaaacttaccacacttaagtcaaaaggattaagtcatgcaacattacttcttaaaacaacaccctgcatccttcatgtaattgcaattcttaccactgggtgaattggggacaaaatatcaggagataactaccacccagcaacaattttttctaatgatttaatctcaaaggaaaactttaattcatatagagaatttgattttgtctgaaagtagctatagaactttttccttttaaacagcatctaccatggttaccaccacttaattaaatcctagatcatgtctacaaaagcagctattgctgaacatttgtctgctaatataagtgaattattactcaatgttttaaaagtaaacattgaccaccatttattactagttatctttgcacaggcatacttgtgactcattgtgtctacatgcaagattgctccacatttctaggcttctgattaaaagtaaaatgaaagggtaatcgaagatgaagaatctcaagtgtcctttccagctctaaaaagacacagcacactgaaggcagggacctcctcttactcttatttgtatctccctcagtctttcactgtatcctacatatatattgccttttggttaagcacattactatggccacgaactaaattcttaaataagaccctaagcccagagaggaaaacaaaacaaaataaagcacatcagtttgacaaaattaaaagcttgcatatggcaaaaagataccataaatcaagataaaagaaaaaaatgaggcaagatattttcaacaaaaataacaaaggaagaacatcctacaaacaagaaaatgacaagcaacccaatcttttcttttaagaaaaaggatataaaaagaagtcaataaagaggaaatcaaaatagtcaatatatatatataaaatgcttaatcccaccaggaaccagagaaatgtaaatgaaaacaaaaagataccaaatttcaactctgaaaaataggaaatattaaaatagccaaaattggcaaagatatagaggaaaaatggtactcattttcttgacagagtataaactgtcagaaccactttttagagcaatctgacagcagctagtacaaatgaagacacacgtgcccacaactcaataactcaaaatctaggcctatgtccaaacccttgttcatctgcacaaggtaacatgcacaaagatgctcactgcacagaacagaaaatgacctatttatttcttaataggaaaacagaaaagtaaagtatacaatatattcccatgatgaaatactaagcagaagaaattaaagagaatgacgtggctctttatagatgaaatgtggacaggttcagaaacagaattgagtgggggaaaaaagcaagatgcaaatgtattcactcataaaaatattctggtattaaataatggcaatggttacacaaccttatgaatatactaaaaaccacagacttgcacactttaaaagggtaaattttgcatgtgaattatatctcaattgtaaaaaaaagattcactagcatgatcctcttcacgttgattttaagacacaatacattattatttgtaagcaacatatatgtgcaaaataaatagaatggaagacagactgaagggttggaagaaaaggctgggaagcattttaaaacattagctgcatctataatagttaattctccagaatccaaacaaggaatcaaataagataatatgtaaacatttattcattcttggtagtggggatttgaatgtttgttatatcattctctgcatttccccatgcttttttttttttaattaaaaaagcagccatggactacaaaggacaaaaaaggcacatcacaaaagacaaacggtaaataaatacataatgaaagatatgtggcactgctaatcatataaatgcaaaccaaaatgaggcagtttttccacacagattggcaaagatttttttaagctgttaatttccagtttatatgcctgaggaaatataaactgggacaatctttttggaggaaagtttggtaatatataacaaaattttaactctgtataccttttgactccacaacctcccttctagaaatttaacataaacaaattattagaaaaaccattaaaatgaatgtcaaagatgtccaccacagcactattcataacaaatcaaaactgggaacaatccaaaagaagtataataaatccatatacaatgtcataccagaaaaatccaacaattttaaaagatgatatgccacaagggtaggaatgttcctctgtgctttatctccagctctaagaagggtgctagggccgggcgcggtgcctcatgcctgtaatctcagcactttggaaggccaaggcgggaggatcacctgaggtcaggagtttgagaccagcctggccaacatggtgaaaccctgtctctactaaaaatacaaaattagccgggcgtggtggcgcatgcctataatcccagctactcgggaggctgaggcaggagaattagttgaacccgggaggcagaagttgcagtgagccaagatcatgccactgcactccagcctgggtgacaagagggaaaccctgtcccaaaatgaaagaaggaaggaaggaaaggagggagggagggagggagggaggtaggcaggcacgcacatagtaggagctaaaaaaaagcacacacttgttgaatgaatgaatgttaatagttaatattgatgtgtatgtgtatatatataaagatgtctaacaaatattaactatagttatatatgaaaatttcagataactcgtccatggtttgacttttctacaatgaacaaatatctacaaattagaaaaaaaaaacatttcatttgtttaaaaaaatgaacaaggttcttcataaaagctacaccacaaaattgtgccatgtaatttcccagcttctatgacatctcttttgaagattcaaaacaagaaaagttctatatcttagaactgtaaaagtgatgttatgtagtggggattacctgtaataaatgactagaaaggcaagaaaggggccaaggttggtccatggaagacccatgagaaagaaacttcaaagaaccaagagaaggaacaaaggacctttaaggcaaaattatcaaaccaagtgatatccctgcctggcctacttcataaagataggtagttctacagaggggcacctacaataatgaatataaaagacttctgcataattcaggtaatgcatcacagaatggacagtgataggccgggcacaatggctcatgcctgtaatctcagcaatttgggagatcgaggctggtgggtcacctgggcccaggagttggagaccagtctgggcaacatagtgaaaccccatctctaccaaaaacacacacacacacaaactgccaggcatggtggtccacgcctatagtctgagctgtttgggaaatggcttgagaccaggagatgggaggatggcttgagtccaggagatggaggttgcaatgagctgaaatcacgcaattacaacccagcctgggtgacagggccagaccatgtgaaaaaaaaaaaaaaaaaaaaaaaaaaaaaaaaaaaagaatggatagtaatagtagctataaaatatgcccagaaaaacccaagtttaaattatccttttctgaaaacaattttgttaggtaatcattcaccggaatttaatgaggcaaataccttggaagatttaccttttctctttccattaaataagtttttattagcaacaataataacaatcagcttccatgtattgggcaatttatgtgtgccagattgtaggctgaatactttctaccagcagttctcggagtgtagagttaggatctcaggatccctatgatcttttcaggtgattggtgacgttaaatctatatatataataaaatctattaagttatgtgcctttttccttcccattctctcgtgagtgtgtagcagagttttccagaggctacaggacatgtgataacacaatagactgaaaagagaagctggtaagaggacctagttgtcttctattaaaacaaagagatttgaaaaaaaaaaaaaaaaagaaaagaaaagtaaacaatgcccctcttgtcactgtttttaagaaaatgttcatttttcattaaaatgttacctgtatgttaacatataataggttactacctttagacaaattaatttctttaaaatgtctccattttaatttctaatacactaaaattaatagatataacttacacaaaaaaactctatgcgttcttcaatttgtaagtgtaaaaggatcttaagcccaataagtatgaaaacagttgatttacatttcaacctcaacttatgaggtaatagttctattttatcatcatttccataatgcaaatgagaaaagagacacagaagtaacttgtccaaaaccatacaaggagtctcttaaaccaacatttgaatacaagtctgtaattcctaaccctaaattctctccatctttaagcaacaatatctacccaagatattaaagatcacttttagatctttaacttttagatagctacatgctaatccctatttttaaaacaatattctatattggttttttattctttttcagttttaaaaagttatgtgtgctcattgaatgttttaaatatacggagttaactttaaaaaaaaatcaaacactacaaaaataacctcccatcaccaccacaagtagctactaaactactagtaagagtttgatgcccgctaatgcaaatttacttatttacagacatacacttgtatagacatacgtatacttatctgcacaagcacttttttgaaaaaatgagatcacaatgatttagcaacttgccttatttcacttaattattcttgaagatcttcctgcatctacaaatagatatacctctttttatagattatcatcatttaattgtatccagttgagggcccctatatggctttcttccaaattttgactattacaaaaacagtcacaagaaacatgctgtatctttgtgtacttgtgagaacatatttgtcagaaaattcctagaagtaaatttgctaggctaaacagtataaacattaaaaatcttaatagaccttgccaatgttctccaaaatacccctgcccgatttacattctcacccacagaatatgagatttccaccaacaattcagcttttaagtgccttggaaaattatactttatgtgcttcaaaatgcacagcagtaaaactgttctcactggtcatctaaatttcatacagaaccctacacaaataacactcgctgaatctatcagaacagtcactcatcttcattttgttccttatatcttttaaatgactctgaagagaaaatataccagatgcacacaacgtcttcagctagtaagccctcaagtattagttaccttgataaaaacttacccaaattatttcagaagaccatttaacacaaatcaaaactatgcagtaaagctggcctcatacacttaaaggaaaattgttagagtggatttattaagctttatctgcccactcaaaggactaaggctacaaataaaaagctatcaaatcctaccagtggccaaattagcttccataaaataataagcaacagatttcatatcataaatgtcagtgaaacaaattgcaatagtaaggatggctgtaactggaaaaaaagttcactcaaattcacatcatactaaaaacaaaaacattaatattttaaaagaaatgttttgaatgtgactattcatttcagtcatatcagactagtacaaatctttggtactaataaataagatattgtctttttttgcaggtaaatagtttaaaaatgcatcatactctgacctacctgttttgtcatggctaatagacattccaggcttcaccatttcatcaaaatctcttttctaagattttgtgccattagttttaaattgaaggtctcccacccatctttgtgacagagtaaaacctcattaattcaaatccaattagctcaattctgaaatggtatacataattctcattaagcaacaagttaaaaatactataattttttctcctacaaattctaatattactgtgaagtaaaggaaatcaacctgaaaatcaattcacttttccaaaccaaagatttacaaaactaaggactctttcatctttgtggctgagcagttcatcctcagtcctaaggctcatctctgtttagcagctactgtatacagtgaaagtgatttagattgtcactatagccaacacagcttatttattatagaatatgagcatttcttttaaagatcttataactcagatttctcacaaattcatattttcagtttctccaatttccaattggtagaattttactctatcacttatagatctacaatatagctaacataacactttaaaaggtactggaagtagacatacaaattcttggcattcttattctatatttattcttatcattttgaaagactttataagccaaaaaataagtcccaggattaagtggcatgtttggtgttgcttgaacttacaactattcccaatgaacagagaaaccttctcttgcaatctgaatcatgtgtaattacagtatgacaaggtctctcctgggtgatgtaagctggcacttttcccaggacttgtcacatcatgggaagcacgcatacaaataaaaatccaaaaataaacattttaaaacaatggcttatagactgcatagagaacctccacagttgagtataaaaattgaggaatccaaccaacaagcagacatctctcaccagagacctctgagaagtcatcactgctatcaagcagcttaccacgcctagcaacaactcccaggtgtggcctatgtgagcagcaccctcatgttccctcagggcagacagaaaatcattaagtataggaaataaaaataacatcaatgcacacatccactgaagcagaaaaacaatggtaaaatagaggttgatcatctttaatttcataatgccaatttgttgattgtcaaggtgcctaaacaaagttaccttaagagctacatcttctgccaactgagttaattttcctaataaatgttgctttttaaaagcttatttcaccttgaagtgaactgcagccaagtagtagtaataatgtgtaccaaggatcttagaaagtggtttcttttgtttaaactcctctgctctacagacacatggaaagggagagagagaatccgagaagcagcatatcaacctcatcagcgatagaaatttgacatcgctcatccttaccacagtttggaggaaatatgaaatataataatctctgactatattttaacataaaatgctaacaaatttcaaatgttatttcctataggccatgcatatttctagccctctataagaaactggatttatttattaaccatccaacaaagaccatcaaattcaaccgttcaagttttcaggaggagttataaaccaaaccactaaaggcaaaaaatacaatcctacttcccattacatgagctctggaaacaaaactaagcaccaatacaaacctctgccacctctaaggcacacgacgcttctcctttctttattcagccccctgaatgttcaataatttccacacagctctaagcagaatggatttattatgatattactctaagaaacgacaggagttctagatgccaataaagattacggatcaaatggaagataactactaaccattgtgtcgacttagataaataaacctgctcacaaacaaagcaccttattgtatttgtactgttaccttcactaatccaactaaaacaaccagacattagttttccagaggttgaagggaaaagaaatcggtatttctcaaaccctctttaaatttctttcaaaatgacactccgtttcttttttccaaaactgtcctgcccattatggaaaatgtttgggaccacagaggcccagtaggattatgcaaactagactccaaggctaagaaccaaggtggggagggactaaagcaaaaggcttcctccacatcgttcctcttcaacttagcttcgacctttgcaagaacagtctccctgcagatcacatccggcagacactttggaacgttgctcagaatcaaaggagcagtcaagtggcacgcgggggtgggagggaggaacgagtaagccccccaagtaaacataaaatccagactggagtgggtgtggcggtggctaagccacaaaaagaaaagtctatggcaactggcacctggtgcctcatacacagacaggaaagcacagaagaccctaaagagaaccgacttgccaagaccgaacaataactacatccaatacattctttgctaataacacaggtaaatcttaatttctctaggaaaacacacacacacacacacacacacacacacacacacacacacgcgcaaagtgtttattccctccagcccgattccccacatctccaaactcaacaactaattgcaccttccccacagaacccgcggctaaccccagaggactggtgagggctggcttgggatgaataaacactcgacacctgacggtcctttctctgcggtgactttcaccaagccgaagtggcgcgcgcgcgggcaggcgggagccgggacctggcccgcgcggcgccgcgcacccggatcccgaggctacgccggcgagcgcggcgcggggggcggggagcgggacagcgggaccgcccgggccaagcgattgtttcaaagacattttttatcaagacccttttgtattcgagccctacctctttttggcctaggaaagctttcgtgcaagtggaagacgactttctccacaaagtgctgtatgttactgtgctccggaccgcgtacgaacaccatccagtcgtgggtgaagccctccacggtgggttttttcctcacctgggcgcggtgccccagctccagcttcacctgcacggcacactgcgggcagggggaggagagacagccgtgaataacaggaaggcgaggtttcggcagtgaacgttgcgcctgacatttttttcctccttcttgaaacgcacataaaaggaaacggcggtgccctctgcatccacgtttcacgcgcgtgggcgcgcacactccacacccccaaatatacccgcccgcccggcccggcttggccccaggcgccccgggccccgcatctacatcggacaggattgtaacggaatgttatccccagtcgggaagggggtcggggaaaagagggagaacacactcagccacgacaagcacgacaacaaatgcatcggaaacaaatcagaaggcgatgccggggcggtttcccggcgtgggaggggaggtggctgggacccagggggaccgaagggctcctggcgagccccctccccgaaagtaccgcggcgacaggcacacgccgaggaagtctttgtgtacgtgtgtgtgcgtgcgtgtggagcgctgtgccaggcgaaatggaaactacaggcagcctctgctgatgggcacaaactcccgtgctcttgccacggggttcgtgcacaacaaaaatgagacgtcgtcatacacactgaaacacacacacacgcccgcaggaaaacacgccgaggcatccataacttagagcaccccgcaccccccagcgaaaagccccacgcgatcggcgaggccagtcgaaccgagcccccgcaacacactttcaagagcccaagtggctccaaagtatctcccacctccccccaaaaaatgaaattcagaaaggcagggcggcgggcggacagccgccgagcctcggctcgcgctcagcacctcccggcgctggggcaaagttgcgtgcggccccgccgctgtcagccccgcacacttcggctcacacacgcgcgccgcggagaacgcaccatcgtagcggccgcggcgctttgcggaggtgcggccgccgaggctgctcgccgcgtccccggactgtgcccgcagctcccggcggcggcggctgaaatatggctgagttattattcgcctccttccaccgtgtgtgtgtgtgtgtgtgagtgcgcgcgtgtgagcgagagggagtgtgtgagtgcgcttcttgtgactgcaaagaggcgaggagggagggaggcgcggggggtggaggggcgagtgtgagcgtgtgtgagtgtgtgtgtgtctgtgtgtctgtgtgcgcgccgggggggggtgggggaggaggggagcggaggctgagggagaggcggcagctccctgcaagccgtaccaacctttctctaattggaaccgcggagcgctggcgctgtctgggctgcggcggcgcagggcgaggaaggaaagtgggggagggcttttattattatttttgcgcgtacttaccgagctagccatgcctgggggcccggaggtttgctggggtgttgtgtggtacccccccctcctccgccccccctcagctgtaattcatgaagaggctgctatgaatgagagcgcgcccaggagcggagggtagatggcggacattctctgcctttttccccccgcgctcgcttgctcgctcgctcgcttattaaactcagccccaaaagcaaaagcagcagcagcagcagcagctccagggtaaagaagatgattgcggagcatgcgccgt
